US011718654B2

(12) United States Patent
Dower et al.

(10) Patent No.: US 11,718,654 B2
(45) Date of Patent: *Aug. 8, 2023

(54) IL-2R-βγ BINDING COMPOUNDS

(71) Applicant: MEDIKINE, INC., Menlo Park, CA (US)

(72) Inventors: William J. Dower, Menlo Park, CA (US); Michael C. Needels, Menlo Park, CA (US); Ronald W. Barrett, Menlo Park, CA (US); Alice V. Bakker, Menlo Park, CA (US); Steven E. Cwirla, Menlo Park, CA (US)

(73) Assignee: MEDIKINE, INC., Menlo Park, CA (US)

( * ) Notice: Subject to any disclaimer, the term of this patent is extended or adjusted under 35 U.S.C. 154(b) by 249 days.

This patent is subject to a terminal disclaimer.

(21) Appl. No.: 17/089,515

(22) Filed: Nov. 4, 2020

(65) Prior Publication Data

US 2021/0198336 A1    Jul. 1, 2021

Related U.S. Application Data

(60) Provisional application No. 62/930,758, filed on Nov. 5, 2019.

(51) Int. Cl.
*C07K 14/55* (2006.01)
*C07K 16/30* (2006.01)
*A61K 38/00* (2006.01)
*A61K 39/00* (2006.01)

(52) U.S. Cl.
CPC .............. *C07K 14/55* (2013.01); *C07K 16/30* (2013.01); *A61K 38/00* (2013.01); *A61K 2039/505* (2013.01); *C07K 2317/92* (2013.01); *C07K 2319/01* (2013.01); *C07K 2319/30* (2013.01); *C07K 2319/75* (2013.01)

(58) Field of Classification Search
None
See application file for complete search history.

(56) References Cited

U.S. PATENT DOCUMENTS

| | | | |
|---|---|---|---|
| 5,635,597 A | 6/1997 | Barrett et al. | |
| 9,861,705 B2 | 1/2018 | Bossard et al. | |
| 10,035,836 B1 | 7/2018 | Greve | |
| 10,689,417 B2 | 6/2020 | Dower et al. | |
| 10,703,776 B2 | 7/2020 | Dower et al. | |
| 11,248,030 B2 * | 2/2022 | Dower | A61P 35/00 |
| 2003/0166163 A1 | 9/2003 | Gillies | |
| 2009/0104218 A1 | 4/2009 | Tettelin et al. | |
| 2011/0243887 A1 | 10/2011 | Lauder et al. | |
| 2013/0330296 A1 | 12/2013 | Khaled | |
| 2017/0327555 A1 | 11/2017 | Greve | |
| 2018/0125941 A1 | 5/2018 | Greve | |
| 2018/0162919 A1 | 6/2018 | Greve et al. | |
| 2018/0362655 A1 | 12/2018 | Wang et al. | |
| 2019/0119346 A1 | 4/2019 | Garcia et al. | |
| 2019/0153058 A1 | 5/2019 | Greve | |
| 2019/0194255 A1 | 6/2019 | Tagaya et al. | |
| 2019/0202881 A1 | 7/2019 | Greve | |
| 2019/0202882 A1 | 7/2019 | Greve | |
| 2020/0040034 A1 | 2/2020 | Dower et al. | |
| 2020/0291066 A1 | 9/2020 | Dower et al. | |
| 2020/0291067 A1 | 9/2020 | Dower et al. | |
| 2021/0130424 A1 | 5/2021 | Dower et al. | |
| 2021/0253669 A1 | 8/2021 | Dower et al. | |
| 2021/0253670 A1 | 8/2021 | Dower et al. | |

FOREIGN PATENT DOCUMENTS

| | | |
|---|---|---|
| JP | 2017528444 | 9/2017 |
| TW | 201833137 | 9/2018 |
| WO | 2010/099084 | 9/2010 |
| WO | 2017/068421 | 4/2017 |
| WO | 2017/136818 | 8/2017 |

OTHER PUBLICATIONS

International Search Report and Written Opinion for PCT Application No. PCT/US2020/058963, dated Apr. 7, 2021, 12 pages.
International Search Report and written Opinion for PCT Application No. PCT/US2020/058969, dated Apr. 6, 2021, 14 pages.
UNIPROTKB Accession No. A0A227JM75, Oct. 25, 2017, retrieved from https://www.uniprot.org/uniprot/A0A227JM75, entire document retrieved on Mar. 22, 2021, 5 pages.
UNIPROTKB Accession No. A0A2D7IYS8, Apr. 25, 2018, retrieved from https://www.uniprot.org/uniprot/A0A2D7IYS8, entire document retrieved on Mar. 19, 2021, 3 pages.
UNIPROTKB Accession No. A0A1D1ZF92, Nov. 30, 2016, retrieved from https://www.uniprot.org/uniprot/A0A1D1ZF92, entire document retrieved on Mar. 19, 2021, 3 pages.
International Search Report and Written Opinion for PCT Application No. PCT/US2021/016356, dated Jul. 13, 2021, 12 pages.
International Search Report and Written Opinion for PCT Application No. PCT/US2021/016361, dated Jul. 15, 2021, 12 pages.
Betts et al., "Chapter 14: Amino Acid Properties and Consequences of Substitutions, Bioinformatics for Geneticists", 2003, Barnes and Gray Eds., 28 pages.
Chen et al., "Fusion Protein Linkers: Property, Design and Functionality", Advanced Drug Delivery Reviews, Oct. 2013, vol. 65, No. 10, pp. 1357-1369.
Dower et al., "MDK/MDK-701: A potent fully efficacious peptidyl agonist of IL-7Rαγc, designed with no reference to cytokine or receptor structure and unrelated to IL-7, fused to an FC-domain for PK enhancement", Journal for ImmunoTherapy of Cancer, 2020, vol. 8, Issue 3, pp. A341-A342.
McElroy et al., "Structural reorganization of the interleukin-7 signaling complex", PNAS, 2012, vol. 109, No. 7, pp. 2503-2508.

(Continued)

*Primary Examiner* — Sergio Coffa

(57) ABSTRACT

IL-2Rβγc binding compounds, and pharmaceutical compositions comprising the IL-2Rβγc binding compounds are disclosed. IL-2Rβγc binding compounds can act as IL-2R agonists and are useful in treating cancer, autoimmune diseases and inflammatory diseases.

22 Claims, 42 Drawing Sheets

Specification includes a Sequence Listing.

(56) References Cited

OTHER PUBLICATIONS

Moors et al., "Interneukin-7 (IL-7) and IL-7 splice variants affect differentiation of human neural progenitor cells", Genes and Immunity, 2010, vol. 11, pp. 11-20.
UNIPROTKB Accession No. A0A444GHQ1, May 8, 2019, retrieved from https://www.uniprot.org/uniprot/A0A444GHQ1, entire document retrieved on Jun. 12, 2021.
UNIPROTKB Accession No. A0A0N1IMW7, Dec. 9, 2015, retrieved from https://www.uniprot.org/uniprot/A0A0N1IMW7, entire document retrieved on Jun. 12, 2021.
Partial International Search for PCT Application No. PCT/US2019/045109, dated Nov. 5, 2019, 17 pages.
International Search Report and Written Opinion for PCT Application No. PCT/US2019/045109, dated Jan. 14, 2020, 20 pages.
Klein et al., "Cergutuzumab amunaleukin (CEA-IL2v), a CEA-targeted IL-2 variant-based immunocytokine for combination cancer immunotherapy: Overcoming limitations of aldeslukin and conventional IL-2-based immunocytokines," OncoImmunology, 2017, vol. 6, No. 3, e1277306, 15 pages.
Levin et al., "Exploiting a natural conformational switch to engineer an interleukin-2 'superkine'," Nature, Apr. 2012, vol. 484, p. 529-533.
Mitra et al., "Interleukin-2 Activity can be Fine-Tuned with Engineered Receptor Signaling Clamps," Immunity, May 2015, vol. 42, No. 5, 29 pages.
Pulliam et al., "Common gamma chain cytokines in combinatorial immune strategies against cancer," Immunology Letters, 2016, vol. 169, p. 61-72.
International Search Report and Written Opinion for PCT Application No. PCT/US2021/058085, dated Jun. 2, 2022, 14 pages.
Rodriguez et al., "Hypothetical protein EBU92_10635 [Betaproteobacteria bacterium]", Genbank online entry, National Center for Biotechnology Information, 2 pages, retrieved from URL https://www.ncbi.nlm.nih.gov/protein/NBO41957.1, retrieved on Jan. 12, 2020.
Silva et al., "De novo design of potent and selective mimics of IL-2 and IL-15", Nature, Jan. 2019, 565(7738), pp. 186-191.

* cited by examiner

| Ligand No. | Orientation P1/P2 | IL-2Rβ Ligand N-terminus | IL-2Rβ Ligand Amino Acid Sequence | IL-2Rβ Ligand C-terminus | Linker Structure | IL-2Rγc Ligand N-terminus | IL-2Rγc Ligand Amino Acid Sequence | IL-2Rγc Ligand C-terminus |
|---|---|---|---|---|---|---|---|---|
| (BGL1) | C/C | H₂N- | -GG-YDCRIAQVGELCDL-GG- SEQ ID NO: 911 | (AL1) | L2 | H₂N- | -DCSMWEGVELCW-GGRR- SEQ ID NO: 1051 | (AZ1) |
| (BGL2) | C/C | H₂N- | -GG-YDCRIAQVGELCDL-GG- SEQ ID NO: 911 | (AL1) | L2 | H₂N- | -GG-VVCQDWEGVELCWQ-GGRR- SEQ ID NO: 1052 | (AZ1) |
| (BGL3) | C/C | H₂N- | -GG-YDCRIAQVGELCDL-GG- SEQ ID NO: 911 | (AL2) | L3 | H₂N- | -GG-VVCQDWEGVELCWQ-GGRR- SEQ ID NO: 1052 | (AZ2) |
| (BGL4) | N/C | (AL3) | -GG-YDCRIAQVGELCDL-GG- SEQ ID NO: 911 | -C(O)-NH₂ | L4 | H₂N- | -DCSMWEGVELCW-GGRR- SEQ ID NO: 1051 | (AZ1) |
| (BGL5) | C/N | H₂N- | -GG-YDCRIAQVGELCDL-GG- SEQ ID NO: 911 | (AL1) | L5 | (AZ3) | -DCSMWEGVELCW-GGRR- SEQ ID NO: 1051 | -C(O)-NH₂ |
| (BGL6) | N/N | (AL3) | -GG-YDCRIAQVGELCDL-GG- SEQ ID NO: 911 | -C(O)-NH₂ | L6 | (AZ3) | -DCSMWEGVELCW-GGRR- SEQ ID NO: 1051 | -C(O)-NH₂ |
| (BGL7) | C/C | H₂N- | -GG-YDCRIAQVGELCDL-GG- SEQ ID NO: 911 | (AL2) | L7 | H₂N- | -DCSMWEGVELCW-GGRR- SEQ ID NO: 1051 | (AZ1) |
| (BGL8) | C/C | H₂N- | -G-VQYKKCWMAQLGDICELDPS-GG- SEQ ID NO: 912 | (AL2) | L3 | H₂N- | -DCSMWEGVELCW-GGRR- SEQ ID NO: 1051 | (AZ2) |
| (BGL9) | C/C | H₂N- | -GG-YPCWMAQLGELCDL-GGRR- SEQ ID NO: 913 | (AL2) | L3 | H₂N- | -DCSMWEGVELCW-GGRR- SEQ ID NO: 1051 | (AZ2) |
| (BGL10) | C/C | H₂N- | -GG-WYPCWMAQLGELCDLD-GGRR- SEQ ID NO: 915 | (AL2) | L3 | H₂N- | -GG-VVCQDWEGVELCWQ-GGRR- SEQ ID NO: 1052 | (AZ2) |
| (BGL11) | C/C | H₂N- | -GG-YPCHMAQLGELCDLWSWGDH-GGRR- SEQ ID NO: 916 | (AL2) | L3 | H₂N- | -DCSMWEGVELCW-GGRR- SEQ ID NO: 1051 | (AZ2) |
| (BGL12) | C/C | H₂N- | -GG-WYPCWMAQLGELCDLD-GGRR- SEQ ID NO: 915 | (AL2) | L3 | H₂N- | -DCSMWEGVELCW-GGRR- SEQ ID NO: 1051 | (AZ2) |
| (BGL13) | C/C | H₂N- | -GG-WYPCWMAQLGELCDLD-GGRR- SEQ ID NO: 915 | (AL2) | L3 | H₂N- | -GG-VMCERWQGVELCWL-GG- SEQ ID NO: 1053 | (AZ2) |

FIG. 19A

| Ligand No. | Orientation P1/P2 | IL-2Rβ Ligand N-terminus | IL-2Rβ Ligand Amino Acid Sequence | IL-2Rβ Ligand C-terminus | Linker Structure | IL-2Rγc Ligand N-terminus | IL-2Rγc Ligand Amino Acid Sequence | IL-2Rγc Ligand C-terminus |
|---|---|---|---|---|---|---|---|---|
| (BGL14) | N/N | (AL4) | –GG–WYPCWMAQLGELCDLD–GG– SEQ ID NO: 9301 | –C(O)–NH₂ | L8 | (AZ4) | –GG–VVCQDWEGVELCWQ–GG– SEQ ID. NO: 1052 | –C(O)–NH₂ |
| (BGL15) | N/C | (AL4) | –GG–WYPCWMAQLGELCDLD–GG– SEQ ID NO: 9301 | –C(O)–NH₂ | L9 | (AZ5) | –GG–VVCQDWEGVELCWQ–GG– SEQ ID NO: 1052 | (AZ5) |
| (BGL16) | N/C | H₃C–C(O)– | –GG–WYPCWMAQLGELCDLD–GG– SEQ ID NO: 9301 | (AL2) | L10 | H₃C–C(O)– | –GG–VVCQDWEGVELCWQ–GG– SEQ ID NO: 1052 | (AZ5) |
| (BGL17) | C/N | H₃C–C(O)– | –GG–WYPCWMAQLGELCDLD–GG– SEQ ID NO: 9301 | (AL2) | L11 | (AZ4) | –GG–VVCQDWEGVELCWQ–GG– SEQ ID NO: 1052 | –COOH |
| (BGL18) | C/N | H₃C–C(O)– | –GG–WYPCWMAQLGELCDLD– SEQ ID NO: 9308 | (AL6) | L12 | (AZ4) | –GG–VVCQDWEGVELCWQ–GG– SEQ ID NO: 1052 | –COOH |
| (BGL19) | C/N | H₃C–C(O)– | –GG–WYPCWMAQLGELCDLD– SEQ ID NO: 9308 | (AL7) | L13 | (AZ4) | –GG–VVCQDWEGVELCWQ–GG– SEQ ID NO: 1052 | –COOH |
| (BGL20) | C/N | H₃C–C(O)– | –GG–WYPCWMAQLGELCDLD SEQ ID NO: 9308 | (AL2) | L11 | (AZ4) | –GG–VVCQDWEGVELCWQ–GG– SEQ ID NO: 1052 | –COOH |
| (BGL21) | C/N | H₃C–C(O)– | –GG–WYPCWMAQLGELCDLD–GG– SEQ ID NO: 9301 | – | L1 | – | –GG–VVCQDWEGVELCWQ–GG– SEQ ID NO: 1052 | –COOH |
| (BGL22) | C/N | H₃C–C(O)– | –GG–WYPCWMAQLGELCDLD–GG– SEQ ID NO: 9301 | (AL2) | L11 | (AZ4) | –GG–RTGVECQDWHGVELCWPVWE–GG– SEQ ID NO: 1054 | –COOH |
| (BGL23) | C/N | H₃C–C(O)– | –GG–WYPCWMAQLGELCDLD–GG– SEQ ID NO: 9301 | (AL2) | L11 | (AZ4) | –GG–VGIECEEWAGVELCWL–GG SEQ ID NO: 1055 | –COOH |
| (BGL24) | C/N | H₃C–C(O)– | –GG–WYPCWMAQLGELCDLD–GG– SEQ ID NO: 9301 | (AL2) | L11 | (AZ4) | –GG–TWNMSELECQDWNGVEICWH–GG– SEQ ID NO: 1056 | –COOH |
| (BGL25) | C/N | H₃C–C(O)– | –GG–WYPCWMAQLGELCDLD–GG– SEQ ID NO: 9301: | (AL2) | L11 | (AZ4) | –GG–RTEVECEDWEGVELCWL–GG– SEQ ID NO: 1057 | –COOH |
| (BGL26) | C/N | H₃C–C(O)– | –FYPCWTALLGELCDLEPGPPAM–GG– SEQ ID NO: 917 | (AL2) | L11 | (AZ4) | –GG–VVCQDWEGVELCWQ–GG– SEQ ID NO: 1052 | –COOH |

FIG. 19B

| Ligand No. | Orientation P1/P2 | IL-2Rβ Ligand | | | Linker Structure | IL-2Rγc Ligand | | |
|---|---|---|---|---|---|---|---|---|
| | | N-terminus | Amino Acid Sequence | C-terminus | | N-terminus | Amino Acid Sequence | C-terminus |
| (BGL27) | C/N | H₃C–C(O)– | –WRRWYPCWVAQVGELCDLEIEA–GG– SEQ ID NO: 918 | (AL2) | L11 | (AZ4) | –GG–VVCQDWEGVELCWQ–GG– SEQ ID NO: 1052 | –COOH |
| (BGL28) | C/N | H₃C–C(O)– | –RQRWYPCWMARLGELCDLDEPT–GG– SEQ ID NO: 919 | (AL2) | L11 | (AZ4) | –GG–VVCQDWEGVELCWQ–GG– SEQ ID NO: 1052 | –COOH |
| (BGL29) | C/N | H₃C–C(O)– | –WYPCWMAQLGDLCDLEKPVTER–GG– SEQ ID NO: 920 | (AL2) | L11 | (AZ4) | –GG–VVCQDWEGVELCWQ–GG– SEQ ID NO: 1052 | –COOH |
| (BGL30) | C/N | H₃C–C(O)– | –GG–WYPCWIAQLGELCDLD–GG– SEQ ID NO: 9301 | (AL2) | L11 | (AZ4) | –GG–VVCQDWEGVELCWQ–GG– SEQ ID NO: 1052 | –COOH |

FIG. 19C (FP1) SEQ ID NO: 1212: hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
ELCDLDGGGGSGGGGVVCQDWEGVELCWQGG (FP2) SEQ ID NO: 1213 hIgG1v-Fc IL-2Rβγc ligand fusion protein
AEPKSSDKTHTCPPCPAPEAAGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALGAPIEKTISKAKGQ
PREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGARTGGGGSGGGGSGGWYPCWMA
QLGELCDLDGGGGSGGGGVVCQDWEGVELCWQGG (FP3) (SEQ ID NO: 1214 hIgG4-Fc IL-2Rβγc ligand fusion protein
APPCPPCPAPEFEGGPSVFLFPPKPKDTLMISRTPEVTCVVVDVSQEDPEVQFNWYVDGVEVHNA
KTKPREEQFNSTYRVVSVLTVLHQDWLNGKEYKCKVSNKGLGSSIEKTISKAKGQPREPQVYTL
PPSQEEMTKNQVSLTCLVKGFYPSDIAVEWESNGQPENNYKTTPPVLDSDGSFFLYSRLTVDKSR
WQEGNVFSCSVMHEALHNHYTQKSLSLSLGARTGGGGSGGGGSGGWYPCWMAQLGELCDLD
GGGGSGGGGVVCQDWEGVELCWQGG (FP4) SEQ ID NO: 1215 hIgG1-Fc (N-terminal fusion) IL-2Rβγc ligand fusion protein
GGWYPCWMAQLGELCDLDGGGGSGGGVVCQDWEGVELCWQGGGGSGGGGSGGGGSRSDKTH
TCPPCPAPELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQVYTLPP
SREEMTKNQVSLTCLVKGFYPSDIAVEWESNGQPENNYKTTPPVLDSDGSFFLYSKLTVDKSRW
QQGNVFSCSVMHEALHNHYTQKSLSLSPGK (FP5) SEQ ID NO: 1216 hIgG1-Fc-Knob IL-2Rβγc ligand fusion protein
GITVAEPKSCDKTHTCPPCPAPEAAGGPSVFLFPPKDTLMISRTPEVTCVVVDVSHEDPEVKFN
WYVDGVEVHNAKTKPREEQYNSTYRVVSVLTVLHQDWLNGKEYKCKVSNKALPAPIEKTISKA

FIG. 20A

KGQPREPQVYTLPPSREEMTKNQVSLWCLVKGFYPSDIAVEWESNGQPENNYKTTPPVLDSDGS
FFLYSKLTVDKSRWQQGNVFSCSVMHEALHNHYTQKSLSLSPGGGGGSGGGGSGGGGSGGWY
PCWMAQLGELCDLDGGGGSGGVVCQDWEGVELCWQGG (FP6) SEQ ID NO: 1217 hIgG1-Fc-Hole
EPKSCDKTHTCPPCPAPEAAGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPAPIEKTISKAKGQP
REPQVYTLPPSREEMTKNQVSLSCAVKGFYPSDIAVEWESNGQPENNYKTTPPVLDSDGSFFLVS
KLTVDKSRWQQGNVFSCSVMHEALHNHYTQKSLSLSPG (FP7) SEQ ID NO: 1218 Pembrolizumab-LC
EIVLTQSPATLSLSPGERATLSCRASKGVSTSGYSYLHWYQQKPGQAPRLLIYLASYLESGVPARF
SGSGSGTDFTLTISSLEPEDFAVYYCQHSRDLPLTFGGGTKVEIKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC (FP8) SEQ ID NO: 1219 Pembrolizumab-HC IL-2Rβγc ligand fusion protein
QVQLVQSGVEVKKPGASVKVSCKASGYTFTNYYMYWVRQAPGQGLEWMGGINPSNGGTNFNE
KFKNRVTLTTDSSTTAYMELSSLQFDDTAVYYCARRDYRFDMGFDYWGQGTTVTVSSASTKG
PSVFPLAPCSRSTSESTAALGCLVKDYFPEPVTVSWNSGALTSGVHTFPAVLQSSGLYSLSSVVTV
PSSSLGTKTYTCNVDHKPSNTKVDKRVESKYGPPCPPCPAPEFLGGPSVFLFPPKPKDTLMISRTP
EVTCVVVDVSQEDPEVQFNWYVDGVEVHNAKTKPREEQFNSTYRVVSVLTVLHQDWLNGKEY
KCKVSNKGLPSSIEKTISKAKGQPREPQVYTLPPSQEEMTKNQVSLTCLVKGFYPSDIAVEWESN
GQPENNYKTTPPVLDSDGSFFLYSRLTVDKSRWQEGNVFSCSVMHEALHNHYTQKSLSLSLGAG
GGGSGGGGSGGWYPCWMAQLGELCDLDGGGGSGGVVCQDWEGVELCWQGG (FP9) SEQ ID NO: 1220 Cemiplimab-LC
DIQMTQSPSSLSASVGDSITITCRASLSINTFLNWYQQKPGKAPNLLIYAASSLHGGVPSRFSGSGS
GTDFTLTIRTLQPEDFATYYCQQSSNTPFTFGPGTVVDFRRTVAAPSVFIFPPSDEQLKSGTASVVC
LLNNFYPREAKVQWKVDNALQSGNSQESVTEQDSKDSTYSLSSTLTLSKADYEKHKVYACEVT
HQGLSSPVTKSFNRGEC

FIG. 20B (FP10) SEQ ID NO: 1221  Cemiplimab-HC IL-2Rβγc ligand fusion protein
EVQLLESGGVLVQPGGSLRLSCAASGFTFSNFGMTWVRQAPGKGLEWVSGISGGGRDTYFADS
VKGRFTISRDNSKNTLYLQMNSLKGEDTAVYYCVKWGNIYFDYWGQGTLVTVSSASTKGPSVF
PLAPCSRSTSESTAALGCLVKDYFPEPVTVSWNSGALTSGVHTFPAVLQSSGLYSLSSVVTVPSSS
LGTKTYTCNVDHKPSNTKVDKRVESKYGPPCPPCPAPEFLGGPSVFLFPPKPKDTLMISRTPEVTC
VVVDVSQEDPEVQFNWYVDGVEVHNAKTKPREEQFNSTYRVVSVLTVLHQDWLNGKEYKCK
VSNKGLPSSIEKTISKAKGQPREPQVYTLPPSQEEMTKNQVSLTCLVKGFYPSDIAVEWESNGQPE
NNYKTTPPVLDSDGSFFLYSRLTVDKSRWQEGNVFSCSVMHEALHNHYTQKSLSLSLGAGGGGS
GGGGSGGWYPCWMAQLGELCDLDGGGGSGGGVVCQDWEGVELCWQGG (FP11) SEQ ID NO: 1222  Daclizumab-LC
DIQMTQSPSTLSASVGDRVTITCSASSSISYMHWYQQKPGKAPKLLIYTTSNLASGVPARFSGSGS
GTEFTLTISSLQPDDFATYYCHQRSTYPLTFGQGTKVEVKRTVAAPSVFIFPPSDEQLKSGTASVV
CLLNNFYPREAKVQWKVDNALQSGNSQESVTEQDSKDSTYSLSSTLTLSKADYEKHKVYACEV
THQGLSSPVTKSFNRGEC (FP12) SEQ ID NO: 1223  Daclizumab-HC IL-2Rβγc ligand fusion protein
QVQLVQSGAEVKKPGSSVKVSCKASGYTFTSYRMHWVRQAPGQGLEWIGYINPSTGYTEYNQK
FKDKATITADESTNTAYMELSSLRSEDTAVYYCARGGGVFDYWGQGTLVTVSSASTKGPSVFPL
APSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPELLGGPSVFLFPPKPKDTLMISRTPEV
TCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNG
QPENNYKTTPPVLDSDGSFFLYSKLTVDKSRWQQGNVFSCSVMHEALHNHYTQKSLSLSPGAGG
GGSGGGGSGGWYPCWMAQLGELCDLDGGGGSGGGVVCQDWEGVELCWQGG (FP13) SEQ ID NO: 1224  hIgG1-Fc (GS)$_{10}$ (N297A mutant) IL-2Rβγc ligand fusion protein
DKTHTCPPCPAPELLGGPSVFLFPPKPKDTLMISRTPEVTCVVVDVSHEDPEVKFNWYVDGVEVH
NAKTKPREEQYASTYRVVSVLTVLHQDWLNGKEYKCKVSNKALPAPIEKTISKAKGQPREPQVY
TLPPSRDELTKNQVSLTCLVKGFYPSDIAVEWESNGQPENNYKTTPPVLDSDGSFFLYSKLTVDK
SRWQQGNVFSCSVMHEALHNHYTQKSLSLSPGAGSGSGSGSGSGSGSGSGSGSGGWYPCWMA

FIG. 20C

QLGELCDLDGGGGSGGVVCQDWEGVELCWQGG (FP14) SEQ ID NO: 1225  hIgG2-Fc (GS)₁₀ IL-2Rβγ ligand fusion protein
ERKSSVECPPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQV
YTLPPSREEMTKNQVSLTCLVKGFYPSDISVEWESNGQPENNYKTTPPMLDSDGSFFLYSKLTVD
KSRWQQGNVFSCSVMHEALHNHYTQKSLSLSPGAGSGSGSGSGSGSGSGGWYPCWM
AQLGELCDLDGGGGSGGVVCQDWEGVELCWQGG (FP15) SEQ ID NO: 1226  hIgG2-Fc (PA)₁₀ IL-2Rβγ ligand fusion protein
ERKSSVECPPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQV
YTLPPSREEMTKNQVSLTCLVKGFYPSDISVEWESNGQPENNYKTTPPMLDSDGSFFLYSKLTVD
KSRWQQGNVFSCSVMHEALHNHYTQKSLSLSPGAPAPAPAPAPAPAPAPAPAGGWYPCWM
AQLGELCDLDGGGGSGGVVCQDWEGVELCWQGG (FP16) SEQ ID NO: 1227  hIgG2-Fc (G4S)₁ IL-2Rβγ ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGWYPCWMAQLGELCDL
DGGGGSGGVVCQDWEGVELCWQGG (FP17) SEQ ID NO: 1228  hIgG2-Fc (G4S)₃ IL-2Rβγ ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGSGGWYPCW
MAQLGELCDLDGGGGSGGVVCQDWEGVELCWQGG (FP18) SEQ ID NO: 1229  hIgG2-Fc (G4S)₄ IL-2Rβγ ligand fusion protein

FIG. 20D

APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGSGGGGSGGGGW
YPCWMAQLGELCDLDGGSGGVVCQDWEGVELCWQGG (FP19) SEQ ID NO: 1230  hIgG2-Fc (G)₂ IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGWYPCWMAQLGELCDLDGG
GGSGGVVCQDWEGVELCWQGG (FP20) SEQ ID NO: 1231  hIgG2-Fc (G)₅ IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGGGGWYPCWMAQLGELCDL
DGGGGSGGVVCQDWEGVELCWQGG (FP21) SEQ ID NO: 1232  hIgG2-Fc (GS)₁₀ IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGSGSGSGSGSGSGSGSGSGSGGWY
PCWMAQLGELCDLDGGGGSGGVVCQDWEGVELCWQGG (FP22) SEQ ID NO: 1233  hIgG2-Fc (PA)₅ IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL

FIG. 20E (FP23) SEQ ID NO: 1234 hIgG2-Fc (PA)₁₀ IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAPAPAPAGGWYP
CWMAQLGELCDLDGGGGSGGVVCQDWEGVELCWQGG (FP24) SEQ ID NO: 1235 hIgG2-Fc (PA)₇ IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAPAGGWYPCWMA
QLGELCDLDGGGGSGGVVCQDWEGVELCWQGG (FP25) SEQ ID NO: 1236 hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGSGVQYKKCWMAQ
LGDLCELDPSGGGGSGGVVCQDWEGVELCWQGG (FP26) SEQ ID NO: 1237 hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGSGGYPCHMAQLGEL
CDLWSWGDIGGGGSGGVVCQDWEGVELCWQGG

FIG. 20F (FP27) SEQ ID NO: 1238  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGYPCWMAQLGEL
CDLGGGGSGGGVVCQDWEGVELCWQGG (FP28) SEQ ID NO: 1239  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
ELCDLDGGGGSGGGWSKKAEVVCEEWGGVEFCWIGG (FP29) SEQ ID NO: 1240  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
ELCDLDGGGGSGGGRTGVECQDWHGVELCWPVWEGG (FP30) SEQ ID NO: 1241  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
ELCDLDGGGGSGGGVGIECEEWAGVELCWLGG (FP31) SEQ ID NO: 1242  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE

FIG. 20G (FP32) SEQ ID NO: 1243  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGWYPCWMAQLG
ELCDLDGGGGSGGGRTEVECEDWEGVELCWLGG (FP33) SEQ ID NO: 1244  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGFYPCWTALLGE
LCDLEPGPPAMGGGGSGGVVCQDWEGVELCWQGG (FP34) SEQ ID NO: 1245  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGWGTTWRWYPC
WMAQLGELCDLEGGGGSGGVVCQDWEGVELCWQGG (FP35) SEQ ID NO: 1246  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGDVLGDRWYPC
WIAKLGELCDLDGGGGSGGVVCQDWEGVELCWQGG

FIG. 20H (FP36) SEQ ID NO: 1247  hIgG2-Fc IL-2Rβγc ligand fusion protein
APLERKSSVECPPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWIAQLGE
LCDLDGGGSGGGVVCQDWEGVELCWQGG (FP37) SEQ ID NO: 1248  hIgG2-Fc
APLERKSSVECPPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWLAKLGE
LCDLDGGGSGGGVVCQDWEGVELCWQGG (FP38) SEQ ID NO: 1249  hIgG2-Fc IL-2Rβγc ligand fusion protein
APLERKSSVECPPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
DLCDLEKPVTERGGGGSGGGVVCQDWEGVELCWQGG (FP39) SEQ ID NO: 1250  hIgG2-Fc IL-2Rβγc ligand fusion protein
APLERKSSVECPPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWRRWYPCWVA
QVGELCDLEIEAGGGGSGGGVVCQDWEGVELCWQGG (FP40) SEQ ID NO: 1251  1hIgG2-Fc IL-2Rβγc ligand fusion protein
APLERKSSVECPPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE

FIG. 20I

PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGRQRWYPCWMA
RLGELCDLDEPTGGGGSGGVVCQDWEGVELCWQGG (FP41) SEQ ID NO: 1252 HSA IL-2Rβγc ligand fusion protein
GGHHHHHHGGDAHKSEVAHRFKDLGEENFKALVLIAFAQYLQQCPFEDHVKLVNEVTEFAKTC
VADESAENCDKSLHTLFGDKLCTVATLRETYGEMADCCAKQEPERNECFLQHKDDNPNLPRLV
RPEVDVMCTAFHDNEETFLKKYLYEIARRHPYFYAPELLFFAKRYKAAFTECCQAADKAACLLP
KLDELRDEGKASSAKQRLKCASLQKFGERAFKAWAVARLSQRFPKAEFAEVSKLVTDLTKVHT
ECCHGDLLECADDRADLAKYICENQDSISSKLKECCEKPLLEKSHCIAEVENDEMPADLPSLAAD
FVESKDVCKNYAEAKDVFLGMFLYEYARRHPDYSVVLLLRLAKTYETTLEKCCAAADPHECYA
KVFDEFKPLVEEPQNLIKQNCELFEQLGEYKFQNALLVRYTKKVPQVSTPTLVEVSRNLGKVGS
KCCKHPEAKRMPCAEDYLSVVLNQLCVLHEKTPVSDRVTKCCTESLVNRRPCFSALEVDETYVP
KEFNAETFTFHADICTLSEKERQIKKQTALVELVKHKPKATKEQLKAVMDDFAAFVEKCCKADD
KETCFAEEGKKLVAASQAALGLRTGGGGSGGGGSGGGGSGGWYPCWMAQLGELCDLDGGGSGGVV
CQDWEGVELCWQGG

FIG. 20J

| IL-2Rβγc Ligand Fusion Protein No. | SEQ ID NO: | Construct Partner | Construct linker | IL-2Rβ Ligand Ligand No. | IL-2Rβ Ligand SEQ ID NO: | IL-2Rβγc Linker | IL-2Rγc Ligand Ligand No. | IL-2Rγc Ligand SEQ ID NO: |
|---|---|---|---|---|---|---|---|---|
| (FP1) | 1212 | hIgG2-Fc | (G4S)2 | (BL4) | 808 | (GGS)1 | (GL2) | 965 |
| (FP2) | 1213 | hIgG1v-Fc | (G4S)2 | (BL4) | 808 | (GGS)1 | (GL2) | 965 |
| (FP3) | 1214 | hIgG4-Fc | (G4S)2 | (BL4) | 808 | (GGS)1 | (GL2) | 965 |
| (FP4) | 1215 | hIgG1-Fc (N-terminal fusion) | (G4S)3 | (BL4) | 808 | (GGS)1 | (GL2) | 965 |
| (FP5) | 1216 | hIgG1-Fc-Knob | (G4S)3 | (BL4) | 808 | (GGS)1 | (GL2) | 965 |
| (FP6) | 1217 | hIgG1-Fc-Hole | — | — | — | — | — | — |
| (FP7) | 1218 | Pembrolizumab-LC | — | — | — | — | — | — |
| (FP8) | 1219 | Pembrolizumab-HC | (G4S)2 | (BL4) | 808 | (GGS)1 | (GL2) | 965 |
| (FP9) | 1220 | Cemiplimab-LC | — | — | — | — | — | — |
| (FP10) | 1221 | Cemiplimab-HC | (G4S)2 | (BL4) | 808 | (GGS)1 | (GL2) | 965 |
| (FP11) | 1222 | Daclizumab-LC | — | — | — | — | — | — |
| (FP12) | 1223 | Daclizumab-HC | (G4S)2 | (BL4) | 808 | (GGS)1 | (GL2) | 965 |
| (FP13) | 1224 | hIgG1-Fc | (GS)10 | (BL4) | 808 | (GGS)1 | (GL2) | 965 |
| (FP14) | 1225 | hIgG2-Fc | (GS)10 | (BL4) | 808 | (GGS)1 | (GL2) | 965 |
| (FP15) | 1226 | hIgG2-Fc | (PA)10 | (BL4) | 808 | (GGS)1 | (GL2) | 965 |
| (FP16) | 1227 | hIgG2-Fc | (G4S)1 | (BL4) | 808 | (GGS)1 | (GL2) | 965 |
| (FP17) | 1228 | hIgG2-Fc | (G4S)3 | (BL4) | 808 | (GGS)1 | (GL2) | 965 |

FIG. 21A

| IL-2Rβγc Ligand Fusion Protein No. | SEQ ID NO: | Construct Partner | Construct linker | IL-2Rβ Ligand Ligand No. | IL-2Rβ Ligand SEQ ID NO: | IL-2Rβγc Linker | IL-2Rγc Ligand Ligand No. | IL-2Rγc Ligand SEQ ID NO: |
|---|---|---|---|---|---|---|---|---|
| (FP18) | 1229 | hIgG2-Fc | (G4S)4 | (BL4) | 808 | (GGS)1 | (GL2) | 965 |
| (FP19) | 1230 | hIgG2-Fc | (G)2 | (BL4) | 808 | (GGS)1 | (GL2) | 965 |
| (FP20) | 1231 | hIgG2-Fc | (G)5 | (BL4) | 808 | (GGS)1 | (GL2) | 965 |
| (FP21) | 1232 | hIgG2-Fc | (G)10 | (BL4) | 808 | (G4S)1 | (GL2) | 965 |
| (FP22) | 1233 | hIgG2-Fc | (PA)5 | (BL4) | 808 | (GGS)1 | (GL2) | 965 |
| (FP23) | 1234 | hIgG2-Fc | (PA)10 | (BL4) | 808 | (GGS)1 | (GL2) | 965 |
| (FP24) | 1235 | hIgG2-Fc | (PA)7 | (BL4) | 808 | (GGS)1 | (GL2) | 965 |
| (FP25) | 1236 | hIgG2-Fc | (G4S)2 | (BL1) | 671 | (GGS)1 | (GL2) | 965 |
| (FP26) | 1237 | hIgG2-Fc | (G4S)2 | (BL2) | 664 | (GGS)1 | (GL2) | 965 |
| (FP27) | 1238 | hIgG2-Fc | (G4S)2 | (BL3) | 662 | (GGS)1 | (GL2) | 965 |
| (FP28) | 1239 | hIgG2-Fc | (G4S)2 | (BL4) | 808 | (GGS)1 | (GL2) | 965 |
| (FP29) | 1240 | hIgG2-Fc | (G4S)2 | (BL4) | 808 | (GGS)1 | (GL3) | 985 |
| (FP30) | 1241 | hIgG2-Fc | (G4S)2 | (BL4) | 808 | (GGS)1 | (GL4) | 1024 |
| (FP31) | 1242 | hIgG2-Fc | (G4S)2 | (BL4) | 808 | (GGS)1 | (GL5) | 980 |
| (FP32) | 1243 | hIgG2-Fc | (G4S)2 | (BL4) | 808 | (GGS)1 | (GL6) | 981 |
| (FP33) | 1244 | hIgG2-Fc | (G4S)2 | (BL6) | 869 | (GGS)1 | (GL7) | 1026 |
| (FP34) | 1245 | hIgG2-Fc | (G4S)2 | (BL5) | 870 | (GGS)1 | (GL2) | 965 |

FIG. 21B

| IL-2Rβγc Ligand Fusion Protein No. | SEQ ID NO: | Construct Partner | Construct linker | IL-2Rβ Ligand | | IL-2Rβ Linker | IL-2Rγc Ligand | |
|---|---|---|---|---|---|---|---|---|
| | | | | Ligand No. | SEQ ID NO: | | Ligand No. | SEQ ID NO: |
| (FP35) | 1246 | hIgG2-Fc | (G4S)$_2$ | (BL9) | 864 | (GGS)$_1$ | (GL2) | 965 |
| (FP36) | 1247 | hIgG2-Fc | (G4S)$_2$ | (BL11) | 874 | (GGS)$_1$ | (GL2) | 965 |
| (FP37) | 1248 | hIgG2-Fc | (G4S)$_2$ | (BL12) | 875 | (GGS)$_1$ | (GL2) | 965 |
| (FP38) | 1249 | hIgG2-Fc | (G4S)$_2$ | (BL10) | 901 | (GGS)$_1$ | (GL2) | 965 |
| (FP39) | 1250 | hIgG2-Fc | (G4S)$_2$ | (BL7) | 856 | (GGS)$_1$ | (GL2) | 965 |
| (FP40) | 1251 | hIgG2-Fc | (G4S)$_2$ | (BL10) | 901 | (GGS)$_1$ | (GL2) | 965 |
| (FP41) | 1252 | HSA | (G4S)$_2$ | (BL4) | 808 | (GGS)$_1$ | (GL2) | 965 |

FIG. 21C

IL-2R-βγ BINDING COMPOUNDS

This application claims the benefit under 35 U.S.C. § 119(e) of U.S. Provisional Application No. 62/930,758 filed on Nov. 5, 2019, which is incorporated by reference in its entirety.

FIELD

The present disclosure relates to IL-2Rβγc binding compounds. The IL-2Rβγc binding compounds can act as IL-2R agonists or partial IL-2R agonists.

SEQUENCE LISTING

The present application contains a Sequence Listing and a copy of the Sequence Listing is submitted electronically in ASCII format and is incorporated by reference in its entirety. The ASCII copy, created on Dec. 15, 2020, is named 62AJ-000410US-320390_SL.txt and is 739,522 bytes in size.

BACKGROUND

Recombinant human Interleukin-2 (IL-2) was one of the first immuno-oncology agents studied in the clinic and was approved by the FDA in the 1990s for use against some particularly challenging cancers such as melanoma and renal carcinoma. IL-2 is effective, producing durable responses in up to 10% of patients with these tumors, but its utility is limited by very serious, dose-limiting toxicities. In addition, the efficacy of IL-2 in directing T-cell-mediated anti-tumor response is compromised by concurrent IL-2-driven upregulation of T-cell suppressive systems. There has been a continuing search for strategies to reduce the toxicity of IL-2 therapy, and to avoid the immunosuppressive limitations on anti-tumor activity. To date, modestly effective strategies have been developed to control systemic exposure, and thus toxicity, of this potent biologic. Elucidation of the complicated biology of IL-2 has led to modifications of the natural IL-2 molecule to alter the balance of tumor toxicity and suppression. However, these approaches are limited by the use of natural IL-2 as a template, thus retaining elements of the undesirable, structure-driven bioactivities of the parent molecule.

Crucial to its anti-tumor properties, IL-2 exerts potent stimulatory effects on NK and cytotoxic CD8+ T-cells. However, the anti-tumor effects are paradoxically suppressed by IL-2-directed stimulation of T-regulatory cells (Tregs), which effectively blunts the anti-tumor immune response. This dual effect of IL-2 is largely controlled by the nature of the IL-2 receptor (IL-2R) subunits expressed on the various cells responsible for immune homeostasis. IL-2 is recognized by combinations of three receptor subunits, which are differentially and conditionally expressed on many types of immune cells. The two signaling subunits, known as IL-2Rβ (β) and IL-2Rγ-common (γc), initiate signaling when brought into correctly oriented apposition by binding to IL-2. IL-2 binds to IL-2Rβγc with an $IC_{50}$ of about 1 nM to form an active ternary complex. Most immune cells express, at various levels, the IL-2Rβ and IL-2Rγc subunits. There is also a third, non-signaling IL-2R subunit, IL-2Rα (CD25), which is expressed on a subset of immune cells, notably Tregs. The complex of IL-2Rαβγc has a very high affinity for IL-2 (about 10 pM), and cells expressing all three subunits are therefore much more sensitive to IL-2. A popular and well-supported strategy for improving the efficacy of IL-2R agonists against tumors involves engineering IL-2R selectivity to reduce the binding of IL-2 to the IL-2Rα subunit while maintaining IL-2Rβγc binding and signaling to favor infiltration and stimulation of cytotoxic effector T-cells (Teff cells) over Tregs at tumor sites.

The cause of IL-2 toxicity in the clinical setting is less well understood; but is thought to be the result of exaggerated peripheral immuno-stimulation of IL-2Rβγc-expressing T-cells accompanied by excessive release of inflammatory cytokines. Toxicity is induced by the frequent administration of high doses of IL-2 required to sustain adequate tumor exposure because of the short half-life of the natural cytokine.

Strategies to address the limitations of IL-2 as a useful immuno-oncology therapy utilize mutants, fusion proteins, or chemically modified IL-2 to alter the complex biology of the immune regulator. However, it is difficult to optimize selective IL-2Rβγc binding and signaling of modified IL-2 during preclinical and clinical development. This limits the use of a bioactive IL-2 protein as a starting point for imparting multiple new properties.

SUMMARY

According to the present invention, an IL-2Rβ ligand, wherein the IL-2Rβ ligand comprises an amino acid sequence of any one of Formula (1)-(1d), Formula (2)-(2d), Formula (3)-(3e), and Formula (4)-(4f), an amino acid sequence of any one of SEQ ID NOS: 805-903, 911-930, 2575-2655, 2661-2891, 2900-2926, and 2929-2939, a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

According to the present invention, an IL-2Rγc ligand, wherein the IL-2Rγc ligand comprises an amino acid sequence of any one of Formula (5)-(5e); an amino acid sequence of any one of SEQ ID NOS: 944-1028, 1032-1060, and 1601-1613, a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

According to the present invention, an IL-2Rβγc ligand comprises an IL-2Rβ ligand according to the present invention and an IL-2Rγc ligand according to the present invention.

According to the present invention, an IL-2Rβγc binding compound comprises an IL-2Rβ ligand according to the present invention and an IL-2Rγc ligand according to the present invention.

According to the present invention, an IL-2Rβγc binding compound comprises an IL-2Rβγc ligand according to the present invention.

According to the present invention, pharmaceutical compositions comprise an IL-2Rβγc binding compound according to the present invention.

According to the present invention, methods of treating a disease in a patient comprising administering to a patient in need of such treatment a therapeutically effective amount of an IL-2Rβγc binding compound according to the present invention, or a pharmaceutical composition according to the present invention.

According to the present invention, methods of expanding immune cells comprising contacting a population of immune cells ex vivo or in vivo with an effective amount of an IL-2Rβ ligand according to the present invention, an IL-2Rγc ligand according to the present invention, or an IL-2Rβγc binding compound according to the present invention.

According to the present invention, methods of cell therapy comprise engineering a cell to express an IL-2Rβγc binding compound according to the present invention.

According to the present invention, methods of boosting a vaccine comprise administering to a patient a vaccine and a therapeutically effective amount of an IL-2Rβγc binding compound according to the present invention, or a pharmaceutical composition according to the present invention.

According to the present invention, methods of modifying the immune response comprise administering to a patient an effective amount of an IL-2Rβγc binding compound according to the present invention, or the pharmaceutical composition according to the present invention.

According to the present invention, a nucleic acid encodes for an IL-2Rβ ligand according to the present invention, an IL-2Rγc ligand according to the present invention, an IL-2Rβγc ligand an IL-2Rβγc binding compound according to the present invention, or an IL-2Rβγc binding compound an IL-2Rβγc binding compound according to the present invention.

BRIEF DESCRIPTION OF THE DRAWINGS

The drawings described herein are for illustration purposes only. The drawings are not intended to limit the scope of the present disclosure.

In FIG. 5A the IL-2Rβ ligand is (BL4) (SEQ ID NO: 865) and is coupled to different IL-2Rγc ligands. In FIG. 5B the IL-2Rγc ligand is (GL2) (SEQ ID NO: 965) and is coupled to different IL-2Rβ ligands.

FIGS. 19A-19C show the amino acid sequences and linker structures for certain IL-2Rβγc ligands provided by the present disclosure. As shown in FIGS. 19A-19C, the IL-2Rβ ligand is coupled to the IL-2Rγc ligand through the linker structure (L). For example, in IL-2Rβγc ligand (BGL1) the C terminus of an IL-2Rβ ligand having SEQ ID NO: 58 is coupled to the C terminus of an IL-2Rγc ligand having SEQ ID NO: 224 through a linker having the structure (L2). As described, IL-2Rβγc ligand (BGL1) is synthesized by reacting an IL-2Rβ ligand having SEQ ID NO: 58 with an H₂N— group on the N terminus and an alkyne moiety (AL1) on the C terminus, with an IL-2Rγc ligand having SEQ ID NO: 224 with an H₂N— group on the N terminus and an azide moiety (AZ1) on the C terminus.

FIGS. 20A-20J show the amino acid sequences for certain IL-2Rβγc ligand fusion proteins provided by the present disclosure.

FIGS. 21A-21C provides a summary of the sub-structures for the IL-2Rβγc ligand constructs provided in FIGS. 20A-20J. FIGS. 21A-C discloses "(G4S)₂" as SEQ ID NO: 9396, "(G4S)₃" as SEQ ID NO: 9397, "(GS)₁₀" as SEQ ID NO: 9407, "(PA)₁₀" as SEQ ID NO: 9428, "(G4S)₁" as SEQ ID NO: 9395, "(GGS)₁" as SEQ ID NO: 9402, "(G4S)₄" as SEQ ID NO: 9398, "(G)₂" as SEQ ID NO: 9399, "(G)₅" as SEQ ID NO: 9401, "(PA)₅" as SEQ ID NO: 9426 and "(PA)₇" as SEQ ID NO: 9427.

DETAILED DESCRIPTION

Figure 1:
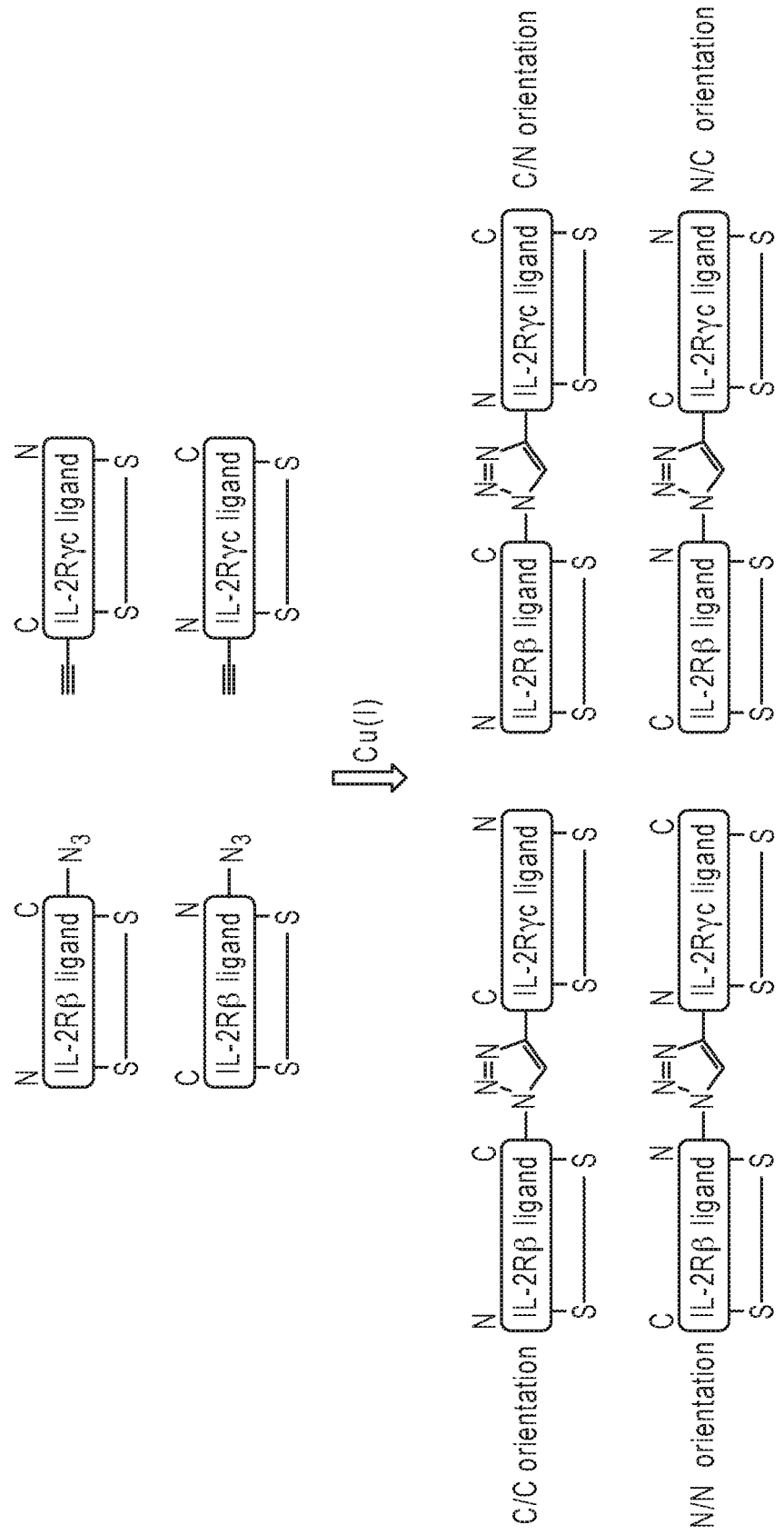
FIG. 1 shows examples of IL-2Rβγc ligands having different C/N orientations of an IL-2Rβ ligand and an IL-2Rγc ligand.

A dash ("-") that is not between two letters or symbols is used to indicate a point of attachment for a moiety or substituent. For example, —CONH₂ is attached through the carbon atom and -X¹-X² denotes amino acids X¹ and X² covalently bound through a single bond.

"Alkyl" refers to a saturated, branched, or straight-chain, monovalent hydrocarbon radical derived by the removal of one hydrogen atom from a single carbon atom of a parent alkane, alkene, or alkyne. Examples of alkyl groups include methyl; ethyls such as ethanyl, ethenyl, and ethynyl; propyls such as propan-1-yl, propan-2-yl, prop-1-en-1-yl, prop-1-en-2-yl, prop-2-en-1-yl (allyl), prop-1-yn-1-yl, prop-2-yn-1-yl, etc.; butyls such as butan-1-yl, butan-2-yl, 2-methyl-propan-1-yl, 2-methyl-propan-2-yl, but-1-en-1-yl, but-1-en-2-yl, 2-methyl-prop-1-en-1-yl, but-2-en-1-yl, but-2-en-2-yl, buta-1,3-dien-1-yl, buta-1,3-dien-2-yl, but-1-yn-1-yl, but-1-yn-3-yl, but-3-yn-1-yl, etc.; and the like. The term "alkyl" is specifically intended to include groups having any degree or level of saturation, i.e., groups having exclusively carbon-carbon single bonds, groups having one or more carbon-carbon double bonds, groups having one or more carbon-carbon triple bonds, and groups having combinations of carbon-carbon single, double, and triple bonds. Where a specific level of saturation is intended, the terms alkanyl, alkenyl, and alkynyl are used. In certain embodiments, an alkyl group is $C_{1-6}$ alkyl, $C_{1-5}$ alkyl, $C_{1-4}$ alkyl, $C_{1-3}$ alkyl, and in certain embodiments, ethyl or methyl.

"Cycloalkyl" refers to a saturated or partially unsaturated cyclic alkyl radical. In certain embodiments, a cycloalkyl group is $C_{3-6}$ cycloalkyl, $C_{3-5}$ cycloalkyl, $C_6$ cycloalkyl, cyclopropyl, cyclopentyl, and in certain embodiments, cyclohexyl. In certain embodiments, cycloalkyl is selected from cyclopropyl, cyclobutyl, cyclopentyl, and cyclohexyl.

"Heterocycloalkyl" by itself or as part of another substituent refers to a saturated or unsaturated cyclic alkyl radical in which one or more carbon atoms (and certain associated hydrogen atoms) are independently replaced with the same or different heteroatom; or to a parent aromatic ring system in which one or more carbon atoms (and certain associated hydrogen atoms) are independently replaced with the same or different heteroatom such that the ring system violates the Huckel-rule. Examples of heteroatoms to replace the carbon atom(s) include N, P, O, S, and Si. Examples of heterocycloalkyl groups include groups derived from epoxides, azirines, thiiranes, imidazolidine, morpholine, piperazine, piperidine, pyrazolidine, pyrrolidine, quinuclidine, and the like. In certain embodiments, heterocycloalkyl is $C_5$ heterocycloalkyl and is selected from pyrrolidinyl, tetrahydrofuranyl, tetrahydrothiophenyl, imidazolidinyl, oxazolidinyl, thiazolidinyl, doxolanyl, and dithiolanyl. In certain embodiments, heterocycloalkyl is $C_6$ heterocycloalkyl and is selected from piperidinyl, tetrahydropyranyl, piperizinyl, oxazinyl, dithianyl, and dioxanyl. A heterocycloalkyl group can be $C_{3-6}$ heterocycloalkyl, $C_{3-5}$ heterocycloalkyl, $C_{5-6}$ heterocycloalkyl, and in certain embodiments, $C_5$ heterocycloalkyl or $C_6$ heterocycloalkyl. A heteroatomic group can be selected from —O—, —S—, —NH—, —N(—CH₃)—, —SO—, and —SO₂—, in certain embodiments, the heteroatomic group is selected from —O— and —NH—, and in certain embodiments the heteroatomic group is —O— or —NH—.

"Binding affinity" refers to the strength of the binding interaction between a single biomolecule and its ligand/binding partner. Binding affinity is expressed as the $IC_{50}$.

"Agonist" refers to a biologically active ligand which binds to its complementary biologically active receptor or subunit(s) and activates the receptor to cause a biological response mediated by the receptor, or to enhance a preexisting biological activity mediated by the receptor.

"Partial agonist" refers to a compound that provides a level of activation, that is, for example, less than 75% of maximum activation, less than 50%, less than 25%, less than 10%, or less than 1% of the maximum activation. A partial IL-2R agonist exhibits a level of activation that is less than the level of activation provided by IL-2. For example, a partial IL-2R agonist exhibits a level of activation that is less than the level of activation provided by IL-2 and a partial IL-2R agonist exhibits a level of activation that is less than the level of activation provided by IL-2.

"Antagonist" refers to a biologically active ligand or compound that binds to its complementary receptor or subunit(s) and blocks or reduces a biological response of the receptor. For example, an IL-2R antagonist binds to IL-2R with an $IC_{50}$ of less than 100 μM and inhibits functional activity of IL-2 as determined, for example, using any of the functional assays disclosed in the examples. For example, an IL-2R antagonist binds to IL-2R with an $IC_{50}$ of less than 100 μM and inhibits functional activity of IL-2 as determined, for example, using any of the functional assays disclosed in the examples.

Amino acid residues are abbreviated as follows: alanine is Ala or A; arginine is Arg or R; asparagine is Asn or N; aspartic acid is Asp or D; cysteine is Cys or C; glutamic acid is Glu or E; glutamine is Gln or Q; glycine is Gly or G; histidine is His or H; isoleucine is Ile or I; leucine is Leu or L; lysine is Lys or K; methionine is Met or M; phenylalanine is Phe or F; proline is Pro or P; serine is Ser or S; threonine is Thr or T; tryptophan is Trp or W; tyrosine is Tyr or Y; and valine is Val or V.

"Non-natural amino acids" include, for example, β-amino acids, homo-amino acids, proline and pyruvic acid derivatives, histidine derivatives with alkyl or heteroatom moieties attached to the imidazole ring, amino acids with pyridine-containing side chains, 3-substituted alanine derivatives, glycine derivatives, ring-substituted phenylalanine and tyrosine derivatives, and N-methyl amino acids.

Amino acids having a large hydrophobic side chain include isoleucine (I), leucine (L), methionine (M), valine (V), phenylalanine (F), tyrosine (Y), and tryptophan (W).

Amino acids having a small hydrophobic side chain include alanine (A), glycine (G), proline (P), serine (S), and threonine (T).

Amino acids having a basic side chain include arginine (R), lysine (K), and histidine (H).

Amino acids having an acidic side chain include aspartate (D) and glutamate (E).

Amino acids having a polar/neutral side chain include histidine (H), asparagine (N), glutamine (Q), serine (S), threonine (T), and tyrosine (Y).

Amino acids having an aromatic side chain include phenylalanine (F), histidine (H), tryptophan (W), and tyrosine (Y).

Amino acids having a hydroxyl side chain include serine (S), threonine (T), and tyrosine (Y).

"Conservative amino acid substitution" means that amino acids within each of the following groups can be substituted with another amino acid within the group: amino acids having a small hydrophobic side chain comprising alanine (A), glycine (G), proline (P), serine (S), and threonine (T); amino acids having a hydroxyl-containing side chain comprising serine (S), threonine (T), and tyrosine (Y); amino acids having an acidic side chain comprising aspartate (D) and glutamate (E); amino acids comprising a polar-neutral side chain comprising histidine (H), asparagine (N), glutamine (Q), serine (S), threonine (T), and tyrosine (Y); amino acids having a basic side chain comprising arginine (R), lysine (K), and histidine (H); amino acids having a large hydrophobic side chain comprising isoleucine (I), leucine (L), methionine (M), valine (V), phenylalanine (F), tyrosine (Y), and tryptophan (W)); and amino acids having an aromatic side chain comprising phenylalanine (F), histidine (H), tryptophan (W), and tyrosine (Y).

"PEG," "polyethylene glycol" and "poly(ethylene glycol)" refer to any suitable nonpeptidic water-soluble poly (ethylene oxide). PEGs can comprise a structure —$(OCH_2CH_2)_n$— where n is, for example, an integer from 1 to 4,000. A PEG can also include moieties such as —$CH_2CH_2$—$O(CH_2CH_2O)_n$—$CH_2CH_2$— and/or —$(OCH_2CH_2)_nO$—, depending upon whether or not the terminal oxygens have been displaced, e.g., during a synthetic transformation. A PEG can be capped with a suitable end group. At least 50% of the repeating subunits of a PEG can have the structure —$CH_2CH_2$—. A PEG can have any suitable molecular weight, structure, and/or geometry such as branched, linear, forked, or multifunctional.

A "physiologically cleavable" or "hydrolyzable" or "degradable" bond is a bond that reacts with water (i.e., is hydrolyzed) under physiological conditions. The tendency of a bond to hydrolyze in water will depend not only on the general type of linkage connecting two central atoms but also on the substituents attached to these central atoms. Suitable hydrolytically unstable or weak linkages include, for example, carboxylate ester, phosphate ester, anhydrides, acetals, ketals, acyloxyalkyl ether, imines, orthoesters, peptides, and oligonucleotides.

An "enzymatically degradable linkage" refers to a chemical linkage that can be degraded or cleaved by one or more enzymes.

A "hydrolytically stable" linkage or bond refers to a chemical bond, such as a covalent bond, that is substantially stable in water such that the chemical bond does not undergo hydrolysis under physiological conditions to any appreciable extent over an extended period of time. Examples of hydrolytically stable linkages include, but are not limited to, the following: carbon-carbon bonds (e.g., in aliphatic chains), ethers, amides, urethanes, and the like. Generally, a hydrolytically stable linkage is one that exhibits a rate of hydrolysis of less than about 1% to 2% per day under physiological conditions.

An "IL-2Rα ligand" refers to a peptide capable of binding to the IL-2Rα subunit of a mammalian IL-2 receptor, such as a human IL-2 receptor, with an $IC_{50}$ less than 100 μM.

An "IL-2Rβ ligand" refers to a peptide capable of binding to the IL-2Rβ subunit of a mammalian IL-2 receptor, such as a human IL-2 receptor, with an $IC_{50}$ less than 100 μM.

An "IL-2Rβ ligand" or an "IL-2Rβ ligand provided by the present disclosure" includes, for example, a peptide having an amino acid sequence of any one of SEQ ID NOS: 805-903, 911-930, 2575-2655, 2661-2891, 2900-2986, and 2989-2939, a truncated amino acid sequence based on SEQ ID NOS: 805-903, 911-930, 2575-2655, 2661-2891, 2900-2986, and 2989-2939, an amino acid sequence having SEQ ID NOS: 805-903, 911-930, 2575-2655, 2661-2891, 2900-2986, and 2989-2939 and flanking amino acids, an amino acid sequence based on SEQ ID NOS: 805-903, 911-930, 2575-2655, 2661-2891, 2900-2986, and 2989-2939 having one or more conservative or non-conservative amino acid substitutions, compounds incorporating one or more amino acid sequences having SEQ ID NOS: 805-903, 911-930, 2575-2655, 2661-2891, 2900-2986, and 2989-2939, or a combination of any of the foregoing.

An "IL-2Rγc ligand" refers to a peptide capable of binding to the IL-2Rγc subunit of a mammalian IL-2 receptor, such as a human IL-2 receptor, with an $IC_{50}$ less than 100 μM.

An "IL-2Rγc ligand" or an "IL-2Rγc ligand provided by the present disclosure" includes, for example, a peptide having an amino acid sequence of any one of SEQ ID NOS: 944-1028, 1032-1060, and 1601-1613, a truncated amino acid sequence based on SEQ ID NOS: 944-1028, 1032-1060, and 1601-1613, an amino acid sequence having SEQ ID NOS: 944-1028, 1032-1060, and 1601-1613 and flanking amino acids, an amino acid sequence based on SEQ ID NOS: 944-1028, 1032-1060, and 1601-1613 having one or more conservative or non-conservative amino acid substitutions, compounds incorporating one or more amino acid sequences having SEQ ID NOS: 944-1028, 1032-1060, and 1601-1613, or a combination of any of the foregoing.

An "IL-2Rβγc ligand" or IL-2Rβγc ligand provided by the present disclosure" includes, for example, an at least one IL-2Rβ ligand provided by the present disclosure and at least one IL-2Rγc ligand provided by the present disclosure.

A ligand comprising an amino acid sequence having SEQ ID NO: refers to a ligand having the amino acid sequence identified by the SEQ ID NO:, a truncated amino acid sequence based on the SEQ ID NO:, an amino acid sequence having the SEQ ID NO: and flanking amino acids, an amino acid sequence based on the SEQ ID NO: having one or more conservative or non-conservative amino acid substitutions, compounds incorporating one or more amino acid sequences having SEQ ID NO:, or a combination of any of the foregoing.

The "hIL-2Rβ subunit" refers to the human (*Homo sapiens*) interleukin-2 receptor subunit β precursor NCBI Reference Sequence NP_000689.1.

The "hIL-2Rγc subunit" refers to the human (*Homo sapiens*) interleukin-2 receptor subunit γ precursor NCBI Reference Sequence NP_000197.1.

The "cyano-IL-2Rβ subunit" refers to the cynomolgus monkey interleukin-2 receptor subunit β precursor NCBI Reference Sequence NP_001244989.1.

The "cyano-IL-2Rγc subunit" refers to the cynomolgus monkey interleukin-2 receptor subunit α precursor NCBI Reference Sequence XP_005593949.

A recombinant "ligand fusion protein" refers to a protein made by recombinant DNA technology in which the translational reading frame of a ligand of a mammalian IL-2 receptor is fused to that of another protein, i.e., the IL-2R ligand fusion partner, to produce a single recombinant polypeptide. A ligand fusion protein can comprise an IL-2Rβ ligand and an IL-2Rγc ligand, an IL-2Rβγc ligand, and/or a tandem IL-2Rβγc ligand. A fusion partner can be the Fc domain of an IgG molecule where the IL-2Rβγc ligand is attached to the two C-termini of the Fc structure. A ligand fusion protein can include a peptidyl linker such as an amino acid sequence located between an IL-2R ligand and a fusion protein partner comprising a fusion protein, such that the peptidyl linker amino acid sequence is not derived from either the IL-2R ligand or the fusion protein partner. Peptidyl linkers can be incorporated into fusion proteins as spacers to promote proper protein folding and stability of the component protein moieties, to improve protein expression, and/or to enable better bioactivity of the two fusion partners. Peptidyl linkers can include, for example, a flexible peptide or a rigid peptide.

An "IL-2Rβγc ligand" refers to a compound consisting of or comprising one or more IL-2Rβ ligands and one or more IL-2Rγc ligands. The one or more IL-2Rβ ligands and one or more IL-2Rγc ligands can be bound to an IL-2Rβγc ligand linker. An IL-2Rβγc ligand can comprise a tandem IL-2Rβγc ligand comprising two or more IL-2Rβγc ligands, or it can comprise a single ligand that simultaneously binds to both the IL-2Rβ subunit and the IL-2Rγc subunit. An IL-2Rβγc ligand is capable of binding to the IL-2Rβ subunit and to the IL-2Rγc subunit of IL-2R with an $IC_{50}$ less than 100 μM.

An "IL-2Rβγc ligand construct" refers to a compound comprising one or more IL-2Rβγc ligands bound to a construct partner. An IL-2Rβγc ligand construct also includes compounds in which one or more IL-2Rβ ligands and one or more IL-2Rγc ligands are bound to a construct partner.

An "IL-2Rβγc binding compound" refers to a compound capable of binding to both the IL-2Rβ and IL-2Rγc subunit and includes an IL-2Rβγc ligand, a tandem IL-2Rβγc ligand, an IL-2Rβγc ligand construct, and to a construct comprising an IL-2Rβ ligand and an IL-2Rγc ligand. An IL-2Rβγc binding compound can bind to both the IL-2Rβ subunit and the IL-2Rγc subunit with an $IC_{50}$, for example, of less than 100 μM such as less than 10 μM, less than 1 μM, or less than 0.1 μM.

Bioisosteres are atoms or molecules that fit the broadest definition for isosteres. The concept of bioisosterism is based on the concept that single atom, groups, moieties, or whole molecules, which have chemical and physical similarities produce similar biological effects. A bioisostere of a parent compound can still be recognized and accepted by its appropriate target, but its functions will be altered as compared to the parent molecule. Parameters influenced by bioisosteric replacements include, for example, size, conformation, inductive and mesomeric effects, polarizability, capacity for electrostatic interactions, charge distribution, H-bond formation capacity, pKa (acidity), solubility, hydrophobicity, lipophilicity, hydrophilicity, polarity, potency, selectivity, reactivity, or chemical and metabolic stability, ADME (absorption, distribution, metabolism, and excretion). Although common in pharmaceuticals, carboxyl groups or carboxylic acid functional groups ($—CO_2H$) in a parent molecule may be replaced with a suitable surrogate or (bio)isostere to overcome chemical or biological shortcomings while retaining the desired attributes of the parent molecule bearing one or more carboxyl groups or carboxylic acid functional groups ($—CO_2H$). IL-2Rβγc ligands include bioisosteres of the IL-2Rβγc ligands provided by the present disclosure.

"Isostere" or "isostere replacement" refers to any amino acid or other analog moiety having physiochemical and/or structural properties similar to a specified amino acid. An "isostere" or "suitable isostere" of an amino acid is another amino acid of the same class, wherein amino acids belong to the following classes based on the propensity of the side chain to be in contact with polar solvent like water: hydrophobic (low propensity to be in contact with water), polar or charged (energetically favorable contact with water). Examples of charged amino acid residues include lysine (+), arginine (+), aspartate (−) and glutamate (−). Examples of polar amino acids include serine, threonine, asparagine, glutamine, histidine and tyrosine. Illustrative hydrophobic amino acids include alanine, valine, leucine, isoleucine, proline, phenylalanine, tryptophan, cysteine and methionine. The amino acid glycine does not have a side chain and is difficult to assign to one of the above classes. However, glycine is often found at the surface of proteins, often within loops, providing high flexibility to these regions, and an isostere may have a similar feature. Proline has the opposite effect, providing rigidity to the protein structure by imposing certain torsion angles on the segment of the polypeptide chain. An isostere can be a derivative of an amino acid, e.g., a derivative having one or more modified side chains as compared to the reference amino acid. IL-2Rβγc ligands include isosteres of the IL-2Rβγc ligands provided by the present disclosure.

"Cyclized" refers to a reaction in which one part of a peptide or polypeptide molecule becomes linked to another part of the peptide or polypeptide molecule to form a closed ring, such as by forming a disulfide bridge or other similar bond, e.g., a lactam bond. In particular embodiments, peptide monomer compounds or monomer subunits of peptide dimer compounds described herein are cyclized via an intramolecular bond between two amino acid residues present in the peptide monomer or monomer subunit. A peptide such as an IL-2Rβγc ligand can include cysteines that are bound together through disulfide bonds and thereby are cyclized IL-2Rβγc ligands.

"Patient" refers to a mammal, for example, a human.

"Peptide" refers to a polymer in which the monomers include amino acids joined together through amide bonds. A peptide can comprise, for example, less than 200 amino acids, less than 100 amino acids, less than 50 amino acids, less than 40 amino acids, less than 30 amino acids, or less than 20 amino acids. A peptide can comprise naturally occurring amino acids, non-naturally occurring amino acids, or a combination thereof.

In addition to peptides consisting only of naturally occurring amino acids, peptidomimetics or peptide analogs are also provided. Peptide mimetics that are structurally similar to therapeutically useful peptides may be used to produce an equivalent or enhanced therapeutic or prophylactic effect. Generally, peptidomimetics are structurally similar to a paradigm peptide, for example, a peptide that has a biological or pharmacological activity, such as a naturally-occurring receptor-binding peptide, but have one or more peptide linkages optionally replaced by a linkage such as $—CH_2—$ NH—, —CH$_2$—S—, —CH$_2$—CH$_2$—, —CH=CH— (cis and trans), —COCH$_2$—, —CH(OH)CH$_2$—, and —CH$_2$SO—, by methods known in the art.

Substitution of one or more amino acids of a consensus sequence with a D-amino acid of the same type, such as D-lysine in place of L-lysine, may be used to generate more stable peptides. In addition, constrained peptides comprising a consensus sequence, or a substantially identical consensus sequence variation may be generated by methods known in the art; for example, by adding internal cysteine residues capable of forming intramolecular disulfide bridges which cyclize the peptide.

Synthetic or non-naturally occurring amino acids refer to amino acids that do not naturally occur in vivo but which, nevertheless, can be incorporated into the peptide ligands provided by the present disclosure. Suitable examples of synthetic amino acids include the D-α-amino acids of naturally occurring L-α-amino acid as well as non-naturally occurring D- and L-α-amino acids represented by the formula H$_2$NCHR$^5$COOH where R$^5$ is C$_{1-6}$ alkyl, C$_{3-8}$ cycloalkyl, C$_{3-8}$ heterocycloalkyl; an aromatic residue of from 6 to 10 carbon atoms optionally having from 1 to 3 substituents on the aromatic nucleus selected from hydroxyl, lower alkoxy, amino, and carboxyl; -alkylene-Y where alkylene is an alkylene group of from 1 to 7 carbon atoms and Y is selected from a hydroxyl, amino, cycloalkyl, and cycloalkenyl having from 3 to 7 carbon atoms; aryl of from 6 to 10 carbon atoms, such as from 1 to 3 substituents on the aromatic nucleus selected hydroxyl, lower alkoxy, amino and carboxyl; heterocyclic of from 3 to 7 carbon atoms and 1 to 2 heteroatoms selected from oxygen, sulfur, and nitrogen; —C(O)R$^2$ where R$^2$ is selected from hydrogen, hydroxy, lower alkyl, lower alkoxy, and —NR$^3$R$^4$ where each of R$^3$ and R$^4$ is independently selected from hydrogen and lower alkyl; —S(O)$_n$R$^6$ where n is 1 or 2 and R$^6$ is C$_{1-6}$ alkyl, and with the proviso that R$^6$ does not define a side chain of a naturally occurring amino acid.

Examples of other synthetic amino acids include amino acids in which the amino group is separated from the carboxyl group by more than one carbon atom such as β-alanine and γ-aminobutyric acid.

Examples of suitable synthetic amino acids include the D-amino acids of naturally occurring L-amino acids, L-1-naphthyl-alanine, L-2-naphthylalanine, L-cyclohexylalanine, L-2-amino isobutyric acid, the sulfoxide and sulfone derivatives of methionine, i.e., HOOC—(H$_2$NCH)CH$_2$CH$_2$—S(O)$_n$R, where n and R are as defined above as well as the lower alkoxy derivative of methionine, i.e., HOOC—(H$_2$NCH)CH$_2$CH$_2$OR where R is as defined above.

"N-terminus" refers to the end of a peptide or polypeptide, such as an N-terminus of an IL-2Rβγc ligand, an IL-2Rβγc ligand construct, an IL-2Rβ ligand, or an IL-2Rγc ligand, that bears an amino group in contrast to the carboxyl end bearing a carboxylic acid group.

"C-terminus" refers to the end of a peptide or polypeptide, such as a C-terminus of an IL-2Rβγc ligand, an IL-2Rβγc ligand construct, an IL-2Rβ ligand or an IL-2Rγc ligand, that bears a carboxylic acid group in contrast to the amino terminus bearing an amino group. In certain synthetic peptides, the N-terminus does not bear an amino group and/or the C-terminus does not bear a carboxyl group. In such cases the nomenclature refers to the direction of the peptide backbone.

"Pharmaceutically acceptable" refers to approved or approvable by a regulatory agency of the Federal or a state government or listed in the U.S. Pharmacopoeia or other generally recognized pharmacopoeia for use in animals, and more particularly in humans.

"Pharmaceutically acceptable salt" refers to a salt of a compound, which possesses a desired pharmacological activity of the parent compound. Such salts include acid addition salts, formed with inorganic acids and one or more protonate-able functional groups such as primary, secondary, or tertiary amines within the parent compound. Examples of inorganic acids include hydrochloric acid, hydrobromic acid, sulfuric acid, nitric acid, and phosphoric acid. A salt can be formed with organic acids such as, for example, acetic acid, propionic acid, hexanoic acid, cyclopentanepropionic acid, glycolic acid, pyruvic acid, lactic acid, malonic acid, succinic acid, malic acid, maleic acid, fumaric acid, tartaric acid, citric acid, benzoic acid, 3-(4-hydroxybenzoyl) benzoic acid, cinnamic acid, mandelic acid, methanesulfonic acid, ethanesulfonic acid, 1,2-ethane-disulfonic acid, 2-hydroxyethanesulfonic acid, benzenesulfonic acid, 4-chlorobenzenesulfonic acid, 2-naphthalenesulfonic acid, 4-toluenesulfonic acid, camphorsulfonic acid, 4-methylbicyclo[2.2.2]-oct-2-ene-1-carboxylic acid, glucoheptonic acid, 3-phenylpropionic acid, trimethylacetic acid, tertiary butylacetic acid, lauryl sulfuric acid, gluconic acid, glutamic acid, hydroxynaphthoic acid, salicylic acid, stearic acid, or muconic acid. A salt can be formed when one or more acidic protons present in the parent compound are replaced by a metal ion, e.g., an alkali metal ion, an alkaline earth ion, or an aluminum ion, or combinations thereof; or coordinates with an organic base such as ethanolamine, diethanolamine, triethanolamine, or N-methylglucamine. A pharmaceutically acceptable salt can be a hydrochloride salt. A pharmaceutically acceptable salt can be a sodium salt. A compound can have two or more ionizable groups, and a pharmaceutically acceptable salt can comprise one or more counterions, such as a bi-salt, for example, a dihydrochloride salt.

"Pharmaceutically acceptable salt" refers to hydrates and other solvates, as well as salts in crystalline or non-crystalline form. Where a particular pharmaceutically acceptable salt is disclosed, it is understood that the particular salt (e.g., a hydrochloride salt) is an example of a salt, and that other salts may be formed using techniques known to one of skill in the art. Additionally, a pharmaceutically acceptable salt to the corresponding compound, free base and/or free acid, using techniques generally known in the art. See also: Stahl and Wermuth, C. G. (Editors), Handbook of Pharmaceutical Salts, Wiley-VCH, Weinheim, Germany, 2008.

"Pharmaceutically acceptable vehicle" refers to a pharmaceutically acceptable diluent, a pharmaceutically acceptable adjuvant, a pharmaceutically acceptable excipient, a pharmaceutically acceptable carrier, or a combination of any of the foregoing with which a compound provided by the present disclosure may be administered to a patient and which does not destroy the pharmacological activity thereof and which is non-toxic when administered in doses sufficient to provide a therapeutically effective amount of the compound.

"Solvate" refers to a molecular complex of a compound with one or more solvent molecules in a stoichiometric or non-stoichiometric amount. Such solvent molecules are those commonly used in the pharmaceutical arts, which are known to be innocuous to a patient, e.g., water, ethanol, and the like. A molecular complex of a compound or moiety of a compound and a solvent can be stabilized by non-covalent intra-molecular forces such as, for example, electrostatic forces, van der Waals forces, or hydrogen bonds. The term "hydrate" refers to a solvate in which the one or more solvent molecules is water.

"Pharmaceutical composition" refers to an IL-2Rβγc binding compound provided by the present disclosure such as IL-2Rβγc ligands or a pharmaceutically acceptable salt thereof and IL-2Rβγc ligand constructs or a pharmaceutically acceptable salt thereof and at least one pharmaceutically acceptable vehicle with which the IL-2Rβγc binding compound or a pharmaceutically acceptable salt thereof is administered to a patient.

"Preventing" or "prevention" refers to a reduction in risk of acquiring a disease or disorder such as, for example causing at least one of the clinical symptoms of the disease not to develop in a patient that may be exposed to or predisposed to the disease but does not yet experience or display symptoms of the disease. In some embodiments, "preventing" or "prevention" refers to reducing symptoms of the disease by taking the compound in a preventative fashion.

"Therapeutically effective amount" refers to the amount of a compound that, when administered to a patient for treating a disease, or at least one of the clinical symptoms of a disease, is sufficient to treat the disease or symptom thereof. A "therapeutically effective amount" may vary depending, for example, on the compound, the disease and/or symptoms of the disease, severity of the disease and/or symptoms of the disease or disorder, the age, weight, and/or health of the patient to be treated, and the judgment of a prescribing physician. An appropriate amount in any given instance may be ascertained by those skilled in the art or capable of determination by routine experimentation.

"Therapeutically effective dose" refers to a dose that provides effective treatment of a disease or disorder in a patient. A therapeutically effective dose may vary from compound to compound, and from patient to patient, and may depend upon factors such as the condition of the patient and the route of delivery. A therapeutically effective dose may be determined in accordance with routine pharmacological procedures known to those skilled in the art.

"Treating" or "treatment" of a disease refers to arresting or ameliorating a disease or at least one of the clinical symptoms of a disease or disorder, reducing the risk of acquiring a disease or at least one of the clinical symptoms of a disease, reducing the development of a disease or at least one of the clinical symptoms of the disease or reducing the risk of developing a disease or at least one of the clinical symptoms of a disease. "Treating" or "treatment" also refers to inhibiting the disease, either physically, (e.g., stabilization of a discernible symptom), physiologically, (e.g., stabilization of a physical parameter), or both, and to inhibiting at least one physical parameter or manifestation that may or may not be discernible to the patient. In certain embodiments, "treating" or "treatment" refers to delaying the onset of the disease or at least one or more symptoms thereof in a patient who may be exposed to or predisposed to a disease or disorder even though that patient does not yet experience or display symptoms of the disease.

"Tregs" or "Treg cells" refer to regulatory T-cells. Regulatory T-cells are a class of T-cells that suppress the activity of other immune cells and are defined using flow cytometry by the cell marker phenotypes CD4+/CD25+/FOXP3+, CD4+CD25+CD127lo, or CD4+/CD25+/FOXP3+/CD127lo. Because FOXP3 is an intracellular protein and requires cell fixation and permeabilization for staining, the cell surface phenotype CD4+CD25+CD127lo− can be used for defining live Tregs. Tregs also include various Treg subclasses, such as tTregs (thymus-derived) and pTregs (peripherally derived, differentiated from naïve T-cells in the periphery). Tregs play a critical role in the induction and maintenance of peripheral self-tolerance to antigens, including those expressed by tumors. "CD4+ T cells" are a type of lymphocyte that functions to coordinate the immune response by stimulating other immune cells such as macrophages, B lymphocytes (B cells), CD8 lymphocytes (CD8 cells) to fight infection. CD4+ T cells recognize peptides presented on MHC Class II molecules, which are found on antigen-presenting cells.

As with CD4+ T cells, "CD8+(cytotoxic) T-cells" are generated in the thymus and express the T-cell receptor. Cytotoxic T-cells express a dimeric co-receptor, CD8, which typically comprises one CD8a and one CD8β chain. CD8+ T-cells recognize peptides presented by MHC Class 1 molecules found on most nucleated cells. The CD8 heterodimer binds to a conservative portion of MHC Class 1 during T-cell/antigen presenting cell interactions. CD8+ T-cells (cytotoxic T lymphocytes, or CTLs) are important for immune defense against intracellular pathogens including viruses and bacteria, and for tumor surveillance.

"NK (natural killer) cells" are lymphocytes of the innate immune system and are classified as group I innate lymphocytes (ILCs). NK cells respond to a wide variety of pathological challenges including by killing virally infected cells and detecting and controlling early signs of cancer.

"Functional activation of cells" refers to an IL-2-mediated response in cells such as, for example, T-cells and NK cells. Assays for functional activation of cells include stimulation of pSTAT5, cell proliferation or markers of proliferation (such as Ki67), change in immune cell type ratios, and stimulation of the levels of effector proteins.

"Effector cells" refers to a population of lymphocytes that mediate the helper (CD4+ cells) and cytotoxic (CD8+ and NK cells) effects. Effector cells include effector T-cells such as CD4+ helper T-cells, CD8+ cytotoxic T-cells, NK cells, lymphokine-activated killer (LAK) cells and macrophages/monocytes.

"Naïve T-cells" refer to T-cells that have differentiated in bone marrow and undergone the positive and negative processes of central selection in the thymus. Naïve T-cells include naïve forms of helper T cells, CD4+ T-cells) and naïve cytotoxic T-cells (CD8+ T-cells). Naïve T-cells are commonly characterized by the surface expression of L-selectin (CD62L) and C—C chemokine receptor type 7 (CCR7) and the expression of IL-7R (CD127) and the absence of the activation markers CD25, CD44, and CD69.

"Memory T-cells" area subset of T lymphocytes including both CD4+ and CD8+, The primary function of memory T-cells is rapid augmented immune response after reactivation of those cells by reintroduction of a relevant antigen or pathogen into the body.

"Antigen binding moiety" refers to a polypeptide molecule that specifically binds to an antigenic determinant. An antigen binding moiety can direct, for example, the entity to which it is attached, such as a cytokine or a second antigen binding moiety, to a target site, for example, to a specific type of tumor cell or tumor stroma bearing the antigenic determinant. Antigen binding moieties include antibodies and fragments thereof. Examples of antigen binding moieties include an antigen binding domain of an antibody comprising an antibody heavy chain variable region and an antibody light chain variable region. An antigen binding moiety can include antibody constant regions. Useful heavy chain constant regions can include any of the five isotypes:

α, δ, ε, γ, or μ. Useful light chain constant regions can include any of the two isotypes K and λ.

"Polypeptide" refers to a molecule composed of monomers (amino acids) linearly linked by amide bonds (also known as peptide bonds). The term "polypeptide" refers to any chain of two or more amino acids and does not refer to a specific length of the product. Thus, peptides, dipeptides, tripeptides, oligopeptides, "protein," "amino acid chain," or any other term used to refer to a chain of two or more amino acids, are included within the definition of "polypeptide," and the term "polypeptide" may be used instead of, or interchangeably with any of these terms. The term "polypeptide" is also intended to refer to the products of post-expression modifications of the polypeptide including, for example, glycosylation, acetylation, phosphorylation, amidation, derivatization by known protecting/blocking groups, proteolytic cleavage, and/or modification by non-naturally occurring amino acids. A polypeptide may be derived from a natural biological source or produced by recombinant technology but is not necessarily translated from a designated nucleic acid sequence. A polypeptide may be generated in any manner, including by recombinant methods or by chemical synthesis. A polypeptide may have, for example, more than 100 amino acids, more than 200 amino acids, more than 500 amino acids, more than 1,000 amino acids, or more than 2,000 amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations and are referred to as unfolded.

"Polynucleotide" refers to an isolated nucleic acid molecule or construct, e.g., messenger RNA (mRNA), virally derived RNA, or plasmid DNA (pDNA). A polynucleotide may comprise a conventional phosphodiester bond or a non-conventional bond, such as an amide bond, such as found in peptide nucleic acids (PNA).

"Nucleic acid molecule" refers to anyone or more nucleic acid segments, such as DNA or RNA fragments, present in a polynucleotide.

"Vector" or "expression vector" is synonymous with "expression construct" and refers to a DNA molecule that is used to introduce and direct the expression of a specific gene to which it is operably associated in a target cell. A vector can be a self-replicating nucleic acid structure as well as a vector incorporated into the genome of a host cell into which it has been introduced. An expression vector can comprise an expression cassette. Expression vectors allow transcription of large amounts of stable mRNA. Once an expression vector is inside the target cell, the ribonucleic acid molecule or protein that is encoded by the gene is produced by the cellular transcription and/or translation machinery. An expression vector can comprise an expression cassette that comprises polynucleotide sequences that encode an IL-2Rβγc binding compound provided by the present disclosure such as an IL-2Rβγc ligand or IL-2Rβγc ligand construct provided by the present disclosure.

"Host cell," "host cell line," and "host cell culture" refer to cells into which are exogenous nucleic acid has been introduced, including the progeny of such cells. Host cells include, for example, "transformants" and "transformed cells," which include the primary transformed cell and progeny derived from the primary transformed cell without regard to the number of passages.

"Antibody" in the broadest sense encompasses various antibody structures including, for example, monoclonal antibodies, polyclonal antibodies, multi-specific antibodies such as bispecific antibodies, and antibody fragments that exhibit a desired antigen binding activity. The term "antibody" can be abbreviated as "ab" such as in the expression Fab or anti-phage Ab.

"Full-length antibody," "intact antibody," and "whole antibody" refer to an antibody having a structure substantially similar to a native antibody structure or having heavy chains that contain both Fab and an Fc region.

"Antibody fragment" refers to a molecule other than an intact antibody that comprises a portion of an intact antibody that binds the antigen to which the intact antibody binds. Examples of antibody fragments include Fv, Fab, Fab', Fab'-SH, F(ab')2, diabodies, linear antibodies, single-chain antibody molecules such as scFv, and multi-specific antibodies formed from antibody fragments. Diabodies are antibody fragments with two antigen binding sites that may be bivalent or bispecific. Antibody fragments can be made by various techniques, including but not limited to proteolytic digestion of an intact antibody as well as production by recombinant host cells such as *E. coli* or phage.

"Fab" or "Fab region" refers to a polypeptide that comprises the VH, CHI, VL, and CL immunoglobulin domains, generally on two different polypeptide chains such as VH-CHI on one chain and VL-CL on the other. Fab may refer to this region in isolation, or this region in the context of a bispecific antibody. In the context of a Fab, the Fab comprises an Fv region in addition to the CHI and CL domains.

"Fv" or "Fv fragment" or "Fv region" refers to a polypeptide that comprises the VL and VH domains of an ABD. Fv regions can be formatted as both Fabs (generally two different polypeptides that also include the constant regions) and scFvs, where the vl and vh domains are combined (generally with a linker as discussed) to form an scFv.

"Single chain Fv" or "scFv" refers to a variable heavy domain covalently attached to a variable light domain, generally using a scFv linker as discussed herein, to form a scFv or scFv domain. A scFv domain can be in either orientation with the VL domain at the N- or C-terminus of the polypeptide, and conversely for the VH domain.

"Effector function" refers to a biochemical event that results from the interaction of an antibody Fc region with an Fc receptor or ligand. Effector functions include, for example, antibody-dependent cellular toxicity (ADCC), antibody-dependent cellular phagocytosis (ADCP), and complement-dependent cytotoxicity (CDC).

"Fc" or "Fc region" or "Fc chain" refers to polypeptide comprising the constant region of an antibody, in some instances, excluding all or a portion of the first constant region immunoglobulin domain (e.g., CHI) or a portion thereof, and in some cases, further excluding all or a portion of the hinge. Thus, an Fc can refer to the last two constant region immunoglobulin domains (e.g., CH2 and CH3) of lgA, IgD, and IgG, the last three constant region immunoglobulin domains of IgE and IgM, and optionally, all or a portion of the flexible hinge N-terminal to these domains. For IgA and IgM, Fc may include the J chain. For IgG, the Fc chain comprises immunoglobulin domains CH2 and CH3 (Cγ2 and Cγ3), and optionally all or a portion of the hinge region between CHI (Cγ1) and CH2 (Cγ2). Although the boundaries of the Fc region may vary, the human IgG heavy chain Fc region is usually defined to include residues E216, C226, or A231 to its carboxyl-terminus, wherein the numbering is according to the EU index as in Kabat. An amino acid modification can be made to the Fc region, for example to alter binding to one or more FcγR or to the FcRn. In EU numbering for human IgG1, the CH2-CH3 domain comprises amino acids 231 to 447, and the hinge is 216 to 230. Thus, the definition of Fc chain includes both amino acids 231-447 (CH2-CH3) or 216-447 (hinge-CH2-CH3), or fragments thereof. An Fc fragment can contain fewer amino acids from either or both of the N- and C-termini that retains the ability to form a dimer with another Fc chain or Fc fragment as can be detected using standard methods, generally based on size (e.g., non-denaturing chromatography, size exclusion chromatography, etc.). Human IgG Fc chains are of particular use, and can be the Fc chain from human IgG1, IgG2 or IgG4.

"Heavy constant region" refers to the CH1-hinge-CH2-CH3 portion of an antibody or fragments thereof, excluding the variable heavy domain; in EU numbering of human IgG1, such as amino acids 118-447.

"Heavy chain constant region fragment" refers to a heavy chain constant region that contains fewer amino acids from either or both of the N- and C-termini that retains the ability to form a dimer with another heavy chain constant region.

"Immunoglobulin" refers to a protein having the structure of a naturally occurring antibody. For example, immunoglobulins of the IgG class are heterotetrameric glycoproteins of about 150,000 Da, composed of two light chains and two heavy chains that are bonded together through disulfide bonds. From N- to C-terminus, each heavy chain has a variable region (VH), also called a variable heavy domain or a heavy chain variable domain, followed by three constant domains (CHI, CH2, and CH3), also called a heavy chain constant region. Similarly, from N- to C-terminus, each light chain has a variable region (VL), also called a variable light domain or a light chain variable domain, followed by a constant light (CL) domain, also called a light chain constant region. The heavy chain of an immunoglobulin may be assigned to one of five classes, called α (IgA), Ii (IgD), E (IgE), y (IgG), or μ (IgM), some of which may be further divided into subclasses, e.g., γ1 (IgG1), γ2 (IgG2), γ3 (IgG3), γ4(gG4), α1 (IgA1) and α2 (IgA2). The light chain of an immunoglobulin may be assigned to one of two types, kappa (k) or lambda (L), based on the amino acid sequence of its constant domain. An immunoglobulin essentially consists of two Fab molecules and an Fc chain, linked via the immunoglobulin hinge region.

"Immunoconjugate" refers to a polypeptide molecule that includes at least one IL-2Rβγc ligand and at least one antigen binding moiety. An immunoconjugate can comprise at least one IL-2Rβγc ligand, and at least two antigen binding moieties. An immunoconjugate can comprise at least one IL-2Rβγc ligand and two antigen binding moieties joined by one or more linker sequences. An antigen binding moiety can be joined to the IL-2Rβγc ligand by a variety of interactions and in a variety of configurations. For example, an IL-2Rβγc ligand can be bound to an antigen binding moiety through a linker.

"Linker" refers to a moiety that binds one compound to another compound. Linkers can include IL-2Rβγc ligand linkers, tandem IL-2Rβγc ligand linkers, and IL-2Rβγc ligand construct linkers. A linker can be a synthetic linker. A linker can be an amino acid linker. For example, linkers provided by the present disclosure can facilitate the ability of an IL-2Rγc ligand to interact with IL-2R, to bind to IL-2R with low $IC_{50}$, and/or to activate IL-2R. A linker can comprise a peptide or a non-peptide. Non-peptide linkers include those containing, for example, a triazole moiety derived from a Cu(I)-catalyzed reaction of alkyne and azide functionalities. An IL-2Rβγc ligand linker refers to a moiety that binds at least one IL-2R ligand such as an IL-2Rβ ligand and/or an IL-2Rγc ligand to another IL-2R ligand. A linker can bind to another IL-2R ligand which can be the same IL-2R ligand or a different IL-2R ligand. A linker can also bind to one or more additional moieties that provide a desired physiological function. A linker can be divalent or multivalent. A linker can be hydrolytically stable or may include a physiologically hydrolyzable or enzymatically degradable or cleavable linkage. A linker can bind IL-2R ligands to form dimers, trimers, or higher order multi-ligand peptides (heteromers) and compounds.

A "flexible linker" refers to a peptidyl linker comprising flexible amino acids such as glycine and serine. A flexible linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from glycine and serine. Examples of flexible linkers include $(G)_n$ (SEQ ID NO: 9380), $(GS)_n$ (SEQ ID NO: 9381), $(GGS)_n$ (SEQ ID NO: 9382), $(GGGS)_n$ (SEQ ID NO: 9383), or $(GGGGS)_n$ (SEQ ID NO: 9384) where n can be an integer from 1 to 20; $(G)_n$ (SEQ ID NO: 9385), $(GS)_n$ (SEQ ID NO: 9386), $(GGS)_n$ (SEQ ID NO: 9387), $(GGGS)_n$ (SEQ ID NO: 9388), or $(GGGGS)_n$ (SEQ ID NO: 9389) where n can be an integer from 1 to 10; or $(G)_n$ (SEQ ID NO: 9390), $(GS)_n$ (SEQ ID NO: 9391), $(GGS)_n$ (SEQ ID NO: 9392), $(GGGS)_n$ (SEQ ID NO: 9393), or $(GGGGS)_n$ (SEQ ID NO: 9394) where n can be an integer from 1 to 5. (A flexible linker can have the amino acid sequence, for example, (GGGGS) (SEQ ID NO: 9395), (GGGGS)2 (SEQ ID NO: 9396), (GGGGS)3 (SEQ ID NO: 9397), (GGGGS)4 (SEQ ID NO: 9398), (GG) (SEQ ID NO: 9399), (GGG) (SEQ ID NO: 9400), (GGGGG) (SEQ ID NO: 9401), (GGS) (SEQ ID NO: 9402), (GGGS) (SEQ ID NO: 9403), (GGGGSGG) (SEQ ID NO: 9404), (GGS)2 (SEQ ID NO: 9405), $(G)_5$ (SEQ ID NO: 9406), or (GS)10 (SEQ ID NO: 9407).

A "rigid linker" refers to a peptidyl linker that is proline rich and can include other amino acids such as alanine, lysine, and/or glutamic acid. A rigid linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from proline, alanine, lysine, and glutamic acid. A rigid linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from proline and alanine. A rigid linker can have the sequence $(P)_n$ (SEQ ID NO: 9420) or $(PA)_n$ (SEQ ID NO: 9421), where n is an integer from 1 to 20. A rigid linker can have the sequence $(P)_n$ (SEQ ID NO: 9422) or $(PA)_n$ (SEQ ID NO: 9423), where n is an integer from 1 to 10. A rigid linker can have the sequence $(P)_n$ (SEQ ID NO: 9424) or $(PA)_n$ (SEQ ID NO: 9425), where n is an integer from 1 to 5. A rigid linker can have the sequence $(PA)_5$ (SEQ ID NO: 9426), $(PA)_7$ (SEQ ID NO: 9427), or $(PA)_{10}$ (SEQ ID NO: 9428).

"Protein" refers to at least two covalently attached amino acids, which includes proteins, polypeptides, oligopeptides and peptides. In addition, polypeptides that make up the antibodies may include synthetic derivatization of one or more side chains or termini, glycosylation, PEGylation, circular permutation, cyclization, linkers to other molecules, fusion to proteins or protein domains, and addition of peptide tags or labels. When a biologically functional molecule comprises two or more proteins, each protein may be referred to as a "monomer" or as a "subunit" or as a "domain"; and the biologically functional molecule may be referred to as a "complex".

"Binding affinity" refers to the strength of the binding interaction between a single biomolecule and its ligand/binding partner. Binding affinity is expressed as the $IC_{50}$. For example, binding affinity of an IL-2Rβγc binding compound refers to the $IC_{50}$ as determined using, for example, a method described in the examples.

"Amino acid sequence similarity" refers to an amino acid sequence in which one or more amino acids of the amino has been replaced with a chemically similar amino acid. Examples of chemically similar amino acids include (a) amino acids having a small hydrophobic side chain such as alanine (A), glycine (G), proline (P), serine (S), or threonine (T); (b) amino acids having a hydroxyl-containing side chain such as serine (S), threonine (T), or tyrosine (Y); (c) amino acids having an acidic side chain such as aspartate (D) or glutamate (E); (d) amino acids having a polar-neutral side chain such as histidine (H), asparagine (N), glutamine (Q), serine (S), threonine (T), or tyrosine (Y); (e) amino acids having a basic side chain such as arginine (R), lysine (K), or histidine (H); (f) amino acids having a large hydrophobic side chain such as isoleucine (I), leucine (L), methionine (M), valine (V), phenylalanine (F), tyrosine (Y), or tryptophan (W); and (g) amino acids having an aromatic side chain comprising phenylalanine (F), histidine (H), tryptophan (W), or tyrosine (Y). A chemically similar amino acid can comprise a naturally occurring amino acid or a non-natural amino acid.

"Percent (%) sequence similarity" is determined by comparing the number of amino acids that are the same in a subject ligand and a reference ligand. A ligand provided by the present disclosure can comprise, for example, greater than 70%, greater than 80%, or greater than 90% sequence similarity to a reference ligand. For example, based on a reference ligand having SEQ ID NO: 9001, ligands having SEQ ID NOS: 9002-9007, have either 1, 2, 3, 4, or 5 amino acid in which an amino acid of the reference ligand has been substituted or replaced with the amino acid, alanine. Ligands having SEQ ID NOS: 9002-9007 are characterized by a 95%, 90%, 85%, 80%, 75%, or 70% sequence similarity, respectively, to the reference ligand.

An amino acid substitution can be independent of other amino acid substitutions.

Each amino acid substitution can independently be a conservative amino acid substitution or a non-conservative amino acid substitution.

For example, a reference ligand can have the amino acid sequence of SEQ ID NO: 9011. Ligands having SEQ ID NOS: 9012-9016 represent substituted ligands in which the reference ligand having SEQ ID NO: 9011 has been substituted with from 1 to 5 conservative amino acid substitutions, respectively.

| | |
|---|---|
| SEQ ID NO: 9011 | Y W C W M A Q V G E L C D L |
| SEQ ID NO: 9012 | Y H C W M A Q V G E L C D L |
| SEQ ID NO: 9013 | Y H C W M G Q V G E L C D L |
| SEQ ID NO: 9014 | Y H C W M G Q M G E L C D L |
| SEQ ID NO: 9015 | Y H C W M G Q M G E L C E L |
| SEQ ID NO: 9016 | Y H C W M G Q M G E L C E M |

An IL-2Rβγc binding compound such as an IL-2Rβγc ligand construct provided by the present disclosure can have, for example, greater than 80%, greater than 85%, greater than 90%, greater than 95%, greater than 96%, greater than 98%, or greater than 99% sequence similarity to an IL-2Rβγc binding compound such as an IL-2Rβγc ligand construct identified by a specific SEQ ID NO: provided by the present disclosure.

A ligand provided by the present disclosure such as an IL-2Rβ ligand, an IL-2Rγc ligand, and an IL-2Rβγc ligand can comprise a truncated ligand. A "truncated ligand" refers to a ligand in which, for example, from 1 to 10 or from 1 to 5 amino acids have independently been removed from the N-terminus, the C-terminus, or from both the N-terminus and the C-terminus of the corresponding reference ligand. A truncated ligand derived from the corresponding reference ligand can independently have, for example from 1 to 5 amino acids, such as from 1 to 4 amino acids, from 1 to 3

| | |
|---|---|
| SEQ ID NO: 9001 | Y P C W L A R V G E L C D L D S G D V H |
| SEQ ID NO: 9002 | A P C W L A R V G E L C D L D S G D V H |
| SEQ ID NO: 9003 | A P C A L A R V G E L C D L D S G D V H |
| SEQ ID NO: 9004 | A P C A L A A V G E L C D L D S G D V H |
| SEQ ID NO: 9005 | A P C A L A A V G A L C D L D S G D V H |
| SEQ ID NO: 9006 | A P C A L A A V G A L C D L A S G D V H |
| SEQ ID NO: 9007 | A P C A L A A V G A L C D L A A G D V H |

For example, an IL-2Rβγc binding compound provided by the present disclosure such as an IL-2Rβγc ligand or can have an amino acid sequence in which, for example, from 1 to 10 amino acids or from 1 to 5 amino acids of a reference amino acid sequence is substituted with another amino acid.

For example, a binding compound derived from a reference binding compound can have from 1 to 5 amino acid substitutions, from 1 to 4, from 1 to 3, or from 1 to 2 amino acid substitutions. For example, a binding compound derived from a reference binding compound can have 1 amino acid substitution, 2 amino acid substitutions, 3 amino acid substitutions, 4 amino acid substitutions, or 5 amino acid substitutions.

amino acids, or from 1 to 2 amino acids independently removed from the N-terminus, the C-terminus, or from both the N-terminus and the C-terminus of the reference ligand. A truncated ligand derived from the corresponding ligand can independently have, for example, 1 amino acid, 2 amino acids, 3 amino acids, 4 amino acids, or 5 amino acids removed from the N-terminus, the C-terminus, or from both the N-terminus and the C-terminus of the reference ligand.

For example, a reference ligand can have the amino acid sequence of SEQ ID NO: 9021. Examples of truncated ligands derived from the reference ligand having SEQ ID NO: 9021 include truncated ligands having an amino acid sequence of SEQ ID NOS: 9022-9029.

| | |
|---|---|
| SEQ ID NO: 9021 | M G F Y P C W T A Q L G E L C D L S V D |
| SEQ ID NO: 9022 | G F Y P C W T A Q L G E L C D L S V D |
| SEQ ID NO: 9023 | F Y P C W T A Q L G E L C D L S V D |
| SEQ ID NO: 9024 | Y P C W T A Q L G E L C D L S V D |
| SEQ ID NO: 9025 | M G F Y P C W T A Q L G E L C D L S V |
| SEQ ID NO: 9026 | M G F Y P C W T A Q L G E L C D L S |
| SEQ ID NO: 9027 | M G F Y P C W T A Q L G E L C D L |
| SEQ ID NO: 9028 | G F Y P C W T A Q L G E L C D L S V |
| SEQ ID NO: 9029 | F Y P C W T A Q L G E L C D L |

The truncated ligands of SEQ ID NOS: 9022-9024 have from 1 to 3 amino acids removed from the N-terminus of the reference ligand, respectively; truncated binding compounds ligands having SEQ ID NOS: 9025 to 9027 have from 1 to 3 amino acids removed from the C-terminus of the reference ligand, respectively; and truncated ligands having SEQ ID NOS: 9028 and 9029 have amino acids removed from both the N-terminus and from the C-terminus of the reference ligand.

As another example, a reference ligand can comprise an amino acid sequence of Formula (A):

$$-X^1-X^2-C-X^3-X^4-X^5-X^6-X^7-X^8-X^9-X^{10}-C-X^{11}-X^{12}-\quad (A)$$

where each -X- independently represents an amino acid. Amino acid sequences of Formula (A1)-(A5) represent examples of truncated ligands derived from the reference ligand comprising the amino acid sequence of Formula (A):

$$-X^2-C-X^3-X^4-X^5-X^6-X^7-X^8-X^9-X^{10}-C-X^{11}-X^{12}-\quad (A1)$$

$$-C-X^3-X^4-X^5-X^6-X^7-X^8-X^9-X^{10}-C-X^{11}-X^{12}-\quad (A2)$$

$$-C-X^3-X^4-X^5-X^6-X^7-X^8-X^9-X^{10}-C-\quad (A3)$$

$$-X^3-X^4-X^5-X^6-X^7-X^8-X^9-X^{10}-C-X^{11}-\quad (A4)$$

$$-X^3-X^4-X^5-X^6-X^7-X^8-X^9-X^{10}-\quad (A5)$$

A ligand provided by the present disclosure can comprise, for example, an amino acid sequence in which from 1 to 3 flanking amino acids such as glycines are independently bonded to the N-terminus, to the C-terminus, or to both the N-terminus and to the C-terminus of a reference ligand.

For example, a reference ligand can have SEQ ID NO: 9031. Ligands having SEQ ID NOS: 9032-9034 have from 1 to 3 glycines bonded to the N-terminus of the reference ligand, respectively; ligands having SEQ ID NOS: 9035-9037 have from 1 to 3 glycines bonded to the C-terminus of the reference ligand, respectively; and ligands having SEQ ID NOS: 9038 and 9039 have 1 or 2 glycines bonded to both the N-terminus and to the C-terminus of the reference ligand.

| | |
|---|---|
| SEQ ID NO: 9031 | K Y C G F A Q L G E L C V L |
| SEQ ID NO: 9032 | G K Y C G F A Q L G E L C V L |
| SEQ ID NO: 9033 | G G K Y C G F A Q L G E L C V L |
| SEQ ID NO: 9034 | G G G K Y C G F A Q L G E L C V L |
| SEQ ID NO: 9035 | K Y C G F A Q L G E L C V L G |
| SEQ ID NO: 9036 | K Y C G F A Q L G E L C V L G G |
| SEQ ID NO: 9037 | K Y C G F A Q L G E L C V L G G G |
| SEQ ID NO: 9038 | G K Y C G F A Q L G E L C V L G |
| SEQ ID NO: 9039 | G G K Y C G F A Q L G E L C V L G |

A ligand provided by the present disclosure can comprise, for example, one or more flanking amino acids such as, for example, flanking glycine groups on the N-terminus and/or the C-terminus of the respective ligand. For example, a ligand can comprise one or more flanking amino acids having an amino acid sequence of any one of SEQ ID NOS: 9380-9407 and 9420-9428.

"IL-2Rβγc binding compound" refers to an IL-2Rβγc ligand provided by the present disclosure, a tandem IL-2Rβγc ligand provided by the present disclosure, an IL-2Rβγc ligand construct provided by the present disclosure, and a construct comprising at least one IL-2Rβ ligand and at least one IL-2Rγc ligand provided by the present disclosure. An IL-2Rβ binding compound can bind to both the IL-2Rβ subunit and to the IL-2Rγc subunit with an $IC_{50}$, for example, less than 100 μM, less than 10 μM, less than 1 μM, less than 0.1 μM, or less than 0.01 μM.

IL-2R, the IL-2Rβ subunit, and the IL-2Rγc subunit refer to mammalian IL-2R, the IL-2Rβ subunit, and the IL-2Rγc subunit, respectively, such as human IL-2R, the human IL-2Rβ subunit, and the human IL-2Rγc subunit, respectively.

The expression "at least one" refers to "one or more." For example, the expression "at least one" can refer to from 1 to 10, from 1 to 8, from 1 to 6, from 1 to 5, from 1 to 4, from 1 to 3, or from 1 to 2. For example, the expression "at least one" can refer to 1, 2, 3, 4, 5, 6, 7, 8, 9, or 10.

Reference is now made in detail to certain embodiments of compounds, compositions, and methods. The disclosed embodiments are not intended to be limiting of the claims. To the contrary, the claims are intended to cover all alternatives, modifications, and equivalents.

Interleukin-2 (IL-2) plays a crucial role in regulating immune responses and maintaining peripheral self-tolerance by having both immuno-stimulatory and immuno-regulatory functions. IL-2 acts primarily as a T-cell growth factor and is essential for the proliferation and survival of T-cells as well as for the generation of effector and memory T-cells. IL-2 is a four α-helical bundle cytokine that belongs to a family of structurally related cytokines that includes IL-4, IL-7, IL-9, IL-15, and IL-21. IL-2 is produced by activated CD4+ T-cells in response to antigen stimulation and can also be produced by CD8+ T-cells and innate immune cells such as activated dendritic cells (DCs) and natural killer (NK) cells.

IL-2 binds to various forms of the IL-2 receptor (IL-2R), notably the monomeric, dimeric, and trimeric forms. Monomeric IL-2R consists of the membrane-associated IL-2Rα (CD25) chain, which also exists in a soluble form; however, IL-2Rα is not capable of inducing signaling events. The trimeric IL-2R consists of IL-2Rα, IL-2Rβ (CD122), and IL-2Rγc, also known as the common γ-chain (γc) or CD132 and is shared by all members of the IL-2 cytokine family. Dimeric IL-2R comprises the IL-2Rγc and IL-2Rβ subunits. In contrast to monomeric IL-2R, activation of both dimeric IL-2R and trimeric IL-2R leads to a downstream signaling cascade upon IL-2 binding. IL-2 binds with high affinity to trimeric IL-2R but with low-moderate affinity to dimeric IL-2R, varying with the sensitivity of the cell to IL-2. Additionally, IL-2 can bind to IL-2Rα expressed on the surface of activated dendritic cells for trans presentation to neighboring cells including antigen-specific naïve T-cells and NK cells that express both the IL-2Rβ and IL-2Rγc subunits. This trans presentation of IL-2 has been shown to facilitate initial high affinity IL-2 signaling, required early in the immune response to prime naïve T-cells to produce IL-2.

IL-2 is first captured by IL-2Rα, bringing about a conformational change to IL-2 and increasing its affinity for IL-2Rβ. Association of IL-2 with the IL-2Rβγc subunits induces the dimerization of the signaling motifs in the cytoplasmic tails of IL-2Rβ and IL-2Rγc leading to the phosphorylation/activation of the Janus kinases, JAK1 and JAK3, which in turn exert kinase activity on key tyrosine residues in the tail of the IL-2Rβ subunit.

Downstream signaling occurs via three major pathways, the JAK-STAT pathway, the phosphoinositide 3-kinase (PI3K)-AKT pathway, and the mitogen-activated protein kinase (MAPK) pathway. These pathways result in the transcription of target genes that contribute to IL-2-dependent biological actions through the recruitment of the adaptor protein Shc and the transcription factor STAT5. Target genes of IL-2 signaling include cyclin D2, bcl-2, fasL, cd25 (encoding IL-2Rα), socs1-2, and the IL-2 silencing gene prdm1, which encodes for the transcription factor, BLIMP1 The production of the negative regulator of IL-2 BLIMP1 maintains the balance between effector T-cells and Treg cells, which is important for immune homeostasis.

IL-2 plays a dual role in T-cell activation by stimulating the proliferation and differentiation of T-cells as well as by maintaining and expanding the population of immuno-suppressive Treg cells Naïve CD4+ and CD8+ T-cells express the dimeric IL-2R, and therefore require a high concentration of IL-2 to induce their initial proliferation. Once activated, these T-cells express the high-affinity trimeric IL-2R, driving the differentiation of the T-cells into either effector (Teff) or memory cells. This differentiation depends on the strength and duration of the IL-2 signal.

During the primary expansion of CD8+ T-cells in the presence of low-to-moderate levels of IL-2, a subset of CD8+ T-cells differentiates into memory T-cells. The cells do this by downregulating CD25 and upregulating CD127 (IL-7R) and CD62 (L-selectin), which are receptors associated with secondary responses upon re-infection. During an acute infection, sustained high levels of IL-2 lead to a rapid upregulation of CD25 and the differentiation of CD8+ cells into cytotoxic effector cells. The upregulation induces an IL-2-driven expression of the death receptor fas and fasL, causing activation-induced cell death (AICD) upon pathogen clearance. For CD4+ T-cells, the activation of STAT5 signaling by IL-2 influences their differentiation into multiple helper T-cell populations, including Th1, Th2, and Th17 by regulating the expression of the appropriate receptors for each response.

Homeostatic or background levels of IL-2 are important for the survival and function of Treg cells by maintaining the expression of FOXP3 and CD25. Treg cells naturally occur in the thymus and upon contact with self-peptides become activated. Additionally, Treg cells can be generated by stimulation of conventional CD4+ T-cells upon interaction with antigens in peripheral lymphoid organs. Because Treg cells do not produce IL-2, Treg cells are dependent on IL-2-producing cells such as conventional T-cells. Due to their high expression of IL-2Rα (CD25), Tregs are able to consume and limit the systemic concentration of IL-2, ensuring regulation of the immune balance. In the absence of IL-2, the number of Treg cells decreases and the number of effector T-cells increases, leading to an enhanced susceptibility to autoimmune and inflammatory disorders. Therefore, the unique activation of Treg cells at low levels of IL-2, which does not activate CD4+ or CD8+ T-cells, has allowed for the development of IL-2 as a promising therapeutic in autoimmune and inflammatory diseases.

The production of IL-2 from both arms of the immune system highlights the importance of this cytokine in the early stages of infection, as well as in the secondary adaptive immune response. Furthermore, the dual functions of IL-2 in both protective immunity and immune tolerance allows IL-2 to be a potential therapeutic in seemingly contrasting therapies, as both an immune stimulant and as an immune suppressor, for cancer and autoimmune disease, respectively.

IL-2Rβγc ligands provided by the present disclosure comprise an IL-2Rβ ligand, an IL-2Rγc ligand, and an IL-2Rβγc ligand linker coupling the IL-2Rβ and IL-2Rγc ligands. An IL-2Rβγc ligand can be an IL-2R agonist, a partial IL-2R agonist, or an IL-2R antagonist. Because the IL-2Rβγc ligands do not bind to IL-2Rα, the IL-2Rβγc ligands do not preferentially activate Tregs, have the potential for lower receptor-mediated clearance, and can exhibit decreased toxicity.

Tandem IL-2Rβγc ligands provided by the present disclosure comprise two or more IL-2Rβγc ligands coupled together by one or more tandem linkers.

IL-2Rβγc constructs provided by the present disclosure can comprise at least one IL-2Rβγc ligand coupled to another molecule referred to as a construct partner such as, for example, a polymer, protein, Fc-fragment, immunoglobulin fragment, or antibody.

IL-2Rβγc constructs provided by the present disclosure can comprise at least one IL-2Rβ ligand and at least one IL-2Rγc coupled to another molecule referred to as a construct partner such as a polymer, protein, Fc-fragment, immunoglobulin fragment, or antibody.

An IL-2Rβγc ligand can comprise an IL-2Rβ ligand. Examples of suitable IL-2Rβ ligands are disclosed in U.S. Application Publication No. 2020/0040034 A1, which is incorporated by reference in its entirety.

An IL-2Rβ ligand provided by the present disclosure can bind to the human IL-2Rβ subunit with an $IC_{50}$, for example, of less than 100 μM, less than 10 μM, less than 1 μM, less than 0.1 μM, or less than 0.01 μM.

An IL-2Rβ ligand can bind to the human IL-2Rβ subunit with an $IC_{50}$, for example, from 1 pM to 100 μM, from 10 pM to 10 µM, from 100 pM to 1 µM, from 0.001 µM to 1 µM, or from 0.01 µM to 1 µM.

An IL-2Rβ ligand provided by the present disclosure can bind to a mammalian IL-2Rβ subunit with an $IC_{50}$ of less than 100 µM, less than 10 µM, less than 1 µM, less than 0.1 µM, or less than 0.01 µM.

An IL-2Rβ ligand can bind to a mammalian IL-2Rβ subunit with an $IC_{50}$, for example, from 1 pM to 100 µM, from 10 pM to 10 µM, from 100 pM to 1 µM, from 0.001 µM to 1 µM, or from 0.01 µM to 1 µM.

An IL-2Rβ ligand provided by the present disclosure can bind to each of the human IL-2Rβ subunit and to the human IL-2Rγc subunit with an $IC_{50}$, for example, of less than 100 µM, less than 10 µM, less than 1 µM, less than 0.1 µM, or less than 0.01 µM.

An IL-20 ligand can comprise the amino acid sequence of Formula (1) (SEQ ID NO: 805), Formula (1a) (SEQ ID NO: 806), Formula (1b) (SEQ ID NO: 807), Formula (1c) (SEQ ID NO: 808), and/or Formula (1d) (SEQ ID NO: 809):

$$-X^{211}-X^{212}-X^{213}-X^{214}-C-X^{215}-X^{216}-X^{217}-X^{218}-X^{219}-X^{220}-X^{221}-X^{222}-C-X^{223}-X^{224}-X^{225}- \quad (1)$$

$$-X^{212}-X^{213}-X^{214}-C-X^{215}-X^{216}-X^{217}-X^{218}-X^{219}-X^{220}-X^{221}-X^{222}-C-X^{223}-X^{224}- \quad (1a)$$

$$-X^{213}-X^{214}-C-X^{215}-X^{216}-X^{217}-X^{218}-X^{219}-X^{220}-X^{221}-X^{222}-C-X^{223}-X^{224}- \quad (1b)$$

$$-X^{214}-C-X^{215}-X^{216}-X^{217}-X^{218}-X^{219}-X^{220}-X^{221}-X^{222}-C-X^{223}- \quad (1c)$$

$$-C-X^{215}-X^{216}-X^{217}-X^{218}-X^{219}-X^{220}-X^{221}-X^{222}-C- \quad (1d)$$

wherein, $X^{211}$ can be selected from an amino acid; $X^{212}$ can be selected from an amino acid comprising an aromatic side chain; $X^{213}$ can be selected from an amino acid comprising a large hydrophobic side chain or an aromatic side chain; $X^{214}$ can be P; $X^{215}$ can be selected from an amino acid comprising an aromatic side chain; $X^{216}$ can be selected from an amino acid comprising a large hydrophobic side chain; $X^{217}$ can be A; $X^{218}$ can be selected from an amino acid comprising a basic side chain or a polar/neutral side chain; $X^{219}$ can be selected from an amino acid comprising a large hydrophobic side chain; $X^{220}$ can be G; $X^{221}$ can be selected from an amino acid comprising an acidic side chain or a polar/neutral side chain; $X^{222}$ can be L; $X^{223}$ can be D; $X^{224}$ can be selected from an amino acid comprising a large hydrophobic side chain; and $X^{225}$ can be selected from an amino acid comprising an acidic side chain.

In IL-2Rβ ligands of Formula (1), (1a), (1b), (1c), and/or (1d), $X^{211}$ can be selected from an amino acid; $X^{212}$ can be selected from F, H, W, and Y; $X^{213}$ can be selected from F, H, I, L, M, V, W, and Y; $X^{214}$ can be P; $X^{215}$ can be selected from F, H, W, and Y; $X^{216}$ can be selected from F, I, L, M, V, W, and Y; $X^{217}$ can be A; $X^{218}$ can be selected from K, R, H, N, Q, S, T, and Y; $X^{219}$ can be selected from F, I, L, M, V, W, and Y; $X^{220}$ can be G; $X^{221}$ can be selected from D, E, H, N, Q, S, T, and Y; $X^{222}$ can be L; $X^{223}$ can be D; $X^{224}$ can be selected from F, I, L, M, V, W, and Y; and $X^{225}$ can be selected from D and E.

In IL-2Rβ ligands of Formula (1), $X^{211}$ can be selected from an amino acid.

In IL-2Rβ ligands of Formula (1), $X^{211}$ can be selected from H, K, and R.

In IL-2Rβ ligands of Formula (1), $X^{211}$ can be selected from H and R.

In IL-2Rβ ligands of Formula (1)-(1a), $X^{212}$ can be selected from F, H, W, and Y.

In IL-2Rβ ligands of Formula (1)-(1a), $X^{212}$ can be W.

In IL-2Rβ ligands of Formula (1)-(1b), $X^{213}$ can be selected from F, H, I, L, M, V, W, and Y.

In IL-2Rβ ligands of Formula (1)-(1b), $X^{213}$ can be L.

In IL-2Rβ ligands of Formula (1)-(1b), $X^{213}$ can be Y.

In IL-2Rβ ligands of Formula (1)-(1c), $X^{214}$ can be P.

In IL-2Rβ ligands of Formula (1)-(1d), $X^{215}$ can be selected from F, H, W, and Y.

In IL-2Rβ ligands of Formula (1)-(1d), $X^{215}$ can be W.

In IL-2Rβ ligands of Formula (1)-(1d), $X^{216}$ can be selected from F, I, L, M, V, W, and Y.

In IL-2Rβ ligands of Formula (1)-(1d), $X^{216}$ can be M.

In IL-2Rβ ligands of Formula (1)-(1d), $X^{217}$ can be A.

In IL-2Rβ ligands of Formula (1)-(1d), $X^{218}$ can be selected from K, R, H, N, Q, S, T, and Y.

In IL-2Rβ ligands of Formula (1)-(1d), $X^{218}$ can be selected from K and R.

In IL-2Rβ ligands of Formula (1)-(1d), $X^{218}$ can be Q.

In IL-2Rβ ligands of Formula (1)-(1d), $X^{219}$ can be selected from F, I, L, M, V, W, and Y.

In IL-2Rβ ligands of Formula (1)-(1d), $X^{219}$ can be L.

In IL-2Rβ ligands of Formula (1)-(1d), $X^{220}$ can be G.

In IL-2Rβ ligands of Formula (1)-(1d), $X^{221}$ can be selected from D, E, H, N, Q, S, T, and Y.

In IL-2Rβ ligands of Formula (1)-(1d), $X^{221}$ can be E.

In IL-2Rβ ligands of Formula (1)-(1d), $X^{22}$ can be L.

In IL-2Rβ ligands of Formula (1)-(1c), $X^{223}$ can be D.

In IL-2Rβ ligands of Formula (1)-(1b), $X^{224}$ can be selected from F, I, L, M, V, W, and Y.

In IL-2Rβ ligands of Formula (1)-(1b), $X^{224}$ can be L.

In IL-2Rβ ligands of Formula (1)-(1a), $X^{225}$ can be selected from D and E.

In IL-2Rβ ligands of Formula (1), (1a), (1b), (1c), and/or (d), $X^{21}$ can be selected from H, K, and R; $X^{212}$ can be W; $X^{213}$ can be Y; $X^{214}$ can be P; $X^{215}$ can be W; $X^{216}$ can be M; $X^{217}$ can be A; $X^{218}$ can be selected N and Q; $X^{219}$ can be selected from L and V; $X^{220}$ can be G; $X^{221}$ can be selected from E, D, and Q; $X^{222}$ can be L; $X^{223}$ can be D; $X^{224}$ can be selected from L and M; and $X^{225}$ can be selected from D and E.

In IL-2Rβ ligands of Formula (1), (1a), (1b), (1c), and/or (1d), $X^{211}$ can be selected from A, D, E, G, H, L, M, N, Q, R, S, T, and V; $X^{212}$ can be selected from C, F, W, and Y; $X^{213}$ can be selected from F, H, K, L, N, Q, R, S, W, and Y; $X^{214}$ can be P; $X^{215}$ can be selected from W and Y; $X^{216}$ can be selected from F, I, K, L, M, R, S, T, and V; $X^{217}$ can be A; $X^{218}$ can be selected from D, E, G, H, K, L, N, Q, R, S, and Y; $X^{219}$ can be selected from L, P, and V; $X^{220}$ can be selected from G, H, and W; $X^{221}$ can be selected from D, E, and Q; $X^{22}$ can be selected from L and M; $X^{223}$ can be D; $X^{224}$ can be selected from L, M, Q, and V; and $X^{225}$ can be selected from A, D, E, F, G, H, L, N, Q, T, and V.

In IL-2Rβ ligands of Formula (1), (1a), (1b), (1c), and/or (1d), $X^{211}$ can be selected from H an R; $X^{212}$ can be selected from F and W; $X^{213}$ can be selected from F, L, W, and Y; $X^{214}$ can be P; $X^{215}$ can be selected from W and Y; $X^{216}$ can be selected from F, I, L, M, and V; $X^{217}$ can be A; $X^{218}$ can be selected D, E, H, K, N, Q, and R; $X^{219}$ can be selected from L and V; $X^{220}$ can be G; $X^{221}$ can be selected from D, E, and Q; $X^{222}$ can be selected from L and M; $X^{223}$ can be D; $X^{224}$ can be selected L, M, and V; and $X^{225}$ can be selected from D and E.

In IL-2Rβ ligands of Formula (1), (1a), (1b), (1c), and/or (1d), $X^{211}$ can be selected from H and R; $X^{212}$ can be W; $X^{213}$ can be Y; $X^{214}$ can be P; $X^{215}$ can be W; $X^{216}$ can be M; $X^{217}$ can be A; $X^{218}$ can be Q; $X^{219}$ can be L; $X^{220}$ can be G; $X^{221}$ can be Q; $X^{222}$ can be L; $X^{223}$ can be D; $X^{224}$ can be L; and $X^{225}$ can be selected from D and E.

In IL-2Rβ ligands of Formula (1), (1a), (1b), (1c), and/or (1d), $X^{211}$ can be selected from H and R; $X^{212}$ can be W; $X^{213}$ can be L; $X^{214}$ can be P; $X^{215}$ can be W; $X^{216}$ can be M; $X^{217}$ can be A; $X^{218}$ can be Q; $X^{219}$ can be L; $X^{220}$ can be G; $X^{221}$ can be Q; $X^{222}$ can be L; $X^{223}$ can be D; $X^{224}$ can be L; and $X^{225}$ can be selected from D and E.

In IL-2Rβ ligands of Formula (1), (1a), (1b), (1c), and/or (1d), $X^{211}$ can be selected from H and R; $X^{212}$ can be W; $X^{213}$ can be Y; $X^{214}$ can be P; $X^{215}$ can be W; $X^{216}$ can be M; $X^{217}$ can be A; $X^{218}$ can be selected from K and R; $X^{219}$ can be L; $X^{220}$ can be G; $X^{221}$ can be Q; $X^{222}$ can be L; $X^{223}$ can be D; $X^{224}$ can be L; and $X^{225}$ can be selected from D and E.

An IL-2Rβ ligand can comprise an amino acid sequence selected from any one of SEQ ID NOS: 810-903.

| | |
|---|---|
| SEQ ID NO: 810 | Q P C W L A Q V G D L C D L L W P G P L |
| SEQ ID NO: 811 | W L P C W I A R L G D L C D L E |
| SEQ ID NO: 812 | W Y P C W M A L L G E L C D Q E |
| SEQ ID NO: 813 | W Y P C Y R A R L G E L C D L D |
| SEQ ID NO: 814 | W Q R E W R W F P C W M A K L G D M C D L D |
| SEQ ID NO: 815 | Q D E A V E W F P C W M A R L G E L C D L E |
| SEQ ID NO: 816 | Y Y P C W M A R L G E L C D L D |
| SEQ ID NO: 817 | S V V V N N W L P C W M A Q L G E L C D L D |
| SEQ ID NO: 818 | W Y P C W L A Q L G D L C D L D |
| SEQ ID NO: 819 | V M S P T R W L P C W I A K L G E L C D L E |
| SEQ ID NO: 820 | W F P C W M A Q L G Q L C D L E |
| SEQ ID NO: 821 | W R P C W R A Y L G E L C D L E A M P R A T |
| SEQ ID NO: 822 | I R S C S P C W S A D V G E L C D L E C E W |
| SEQ ID NO: 823 | S G H W Y P C W M A R L G E L C D M E E R A |
| SEQ ID NO: 824 | W Y P C W M A Q L G E L C D L Q T M G Y S H |
| SEQ ID NO: 825 | A G D W L P C W M A E L G E L C D L E G P T |
| SEQ ID NO: 826 | W L P C W I A S L G E L C D L D T G K R Q G |
| SEQ ID NO: 827 | W L P C W M A H L G Q L C D L D L P G K S M |
| SEQ ID NO: 828 | E G V F F P C W I A R L G E L C D L D H G L |
| SEQ ID NO: 829 | T G R W K P C W M A G L H E L C D L E G F R |
| SEQ ID NO: 830 | R K H F Y P C W M A Q L G E L C D L E G M P |
| SEQ ID NO: 831 | D I G Y Y P C W M A Q V G D L C D L D D E K |
| SEQ ID NO: 832 | D S D W W P C W M A Q L G E L C D L E D A R |
| SEQ ID NO: 833 | G E R W K P C W I A Q L G E L C D L D F N W |
| SEQ ID NO: 834 | W W P C W M A Q L G E M C D L E Y P Y V P G |
| SEQ ID NO: 835 | Q T K L E G W Y P C W M A Q L G E L C D L D |
| SEQ ID NO: 836 | W G R K E Q W L P C W K A Q L G E L C D L E |
| SEQ ID NO: 837 | V P R A N A W H P C W M A Q L G E L C D L E |
| SEQ ID NO: 838 | G R Q Q K G W Y P C W L A Q L G E L C D M E |
| SEQ ID NO: 839 | W L N R H L F N P C W M A R L G E L C D L E |
| SEQ ID NO: 840 | A Q V R R E W Y P C W M A Q L G E L C D L T |
| SEQ ID NO: 841 | E T E Q M S W Y P C W V A Q L W E L C D L D |
| SEQ ID NO: 842 | W L P C W L A K L G E L C D L E W L P C W |
| SEQ ID NO: 843 | E R R P D T W F P C W R A L V G E L C D L E |

-continued

| SEQ ID NO: 844 | W G R N R S W Y P C W M A Q L G E L C D L E |
| SEQ ID NO: 845 | Q D R R S P W Y P C W M A K L G E L C D L A |
| SEQ ID NO: 846 | T R R W Y P C Y L A K L G E L C D L F E G G T R |
| SEQ ID NO: 847 | S E Q W W P C W I A R L G E L C D L D R E L S E |
| SEQ ID NO: 848 | W Y P C W V A Q L G E I C D L E M T G P D S W Y P |
| SEQ ID NO: 849 | Q D G W L P C W M A Q L G E L C D L E Y K R |
| SEQ ID NO: 850 | N R R W Y P C W M A Q L G E L C D L D S R P |
| SEQ ID NO: 851 | F Y P C W M A H L G E L C D L D G D T D S M |
| SEQ ID NO: 852 | K S N F F P C W I A Q L G Q L C D L E P E T |
| SEQ ID NO: 853 | F Y P C W M A N L G E L C D L D F L R E L N |
| SEQ ID NO: 854 | H A S W L P C W L A Q L G E L C D L E P N P |
| SEQ ID NO: 855 | N G A W Y P C W M A Q V G E L C D L E E R W |
| SEQ ID NO: 856 | W R R W Y P C W V A Q V G E L C D L E I E A |
| SEQ ID NO: 857 | R Q A W Y P C W M A Q L G E L C D L E A E L |
| SEQ ID NO: 858 | R Q R W Y P C W M A R L G E L C D L D E P T |
| SEQ ID NO: 859 | N N S R E G W F P C W L A K L G D L C D L D |
| SEQ ID NO: 860 | Y Y P C W M A Q L G E L C D L E |
| SEQ ID NO: 861 | W Y P C W L A Q L G E L C D L D |
| SEQ ID NO: 862 | S W H A E T W Y P C W L A Q V G E L C D L D |
| SEQ ID NO: 863 | K M H K A V W L P C W M A Q V G E L C D L E |
| SEQ ID NO: 864 | D V L G D R W Y P C W I A K L G E L C D L D |
| SEQ ID NO: 865 | W Y P C W M A Q L G E L C D L D |
| SEQ ID NO: 866 | K L Q S W R W Y P C W M A Q L G E L C D L D |
| SEQ ID NO: 867 | N E P E G G F Y P C W L A Q L G E L C D L H |
| SEQ ID NO: 868 | W Y P C W M A R L G E L C D L E |
| SEQ ID NO: 869 | F Y P C W T A L L G E L C D L E P G P P A M |
| SEQ ID NO: 870 | W G T T W R W Y P C W M A Q L G E L C D L E |
| SEQ ID NO: 871 | A K G W D T W K P C W L A N L G E L C D L E |
| SEQ ID NO: 872 | R D E S A G Y Y P C W I A Q L G E L C D L E |
| SEQ ID NO: 873 | W Y P C W I A K L G E L C D L E |
| SEQ ID NO: 874 | W Y P C W I A Q L G E L C D L D |
| SEQ ID NO: 875 | W Y P C W L A K L G E L C D L D |
| SEQ ID NO: 876 | Q G P V R L W Y P C W M A Q L G E L C D L D |
| SEQ ID NO: 877 | W Y P C W M A Q P G E L C D V D |
| SEQ ID NO: 878 | W H P C W I A Q L G E L C D L E |
| SEQ ID NO: 879 | W Y P C W I A Q L G E L C D L E |
| SEQ ID NO: 880 | V R P M G V W Y P C W I A Q L G E L C D L V |
| SEQ ID NO: 881 | V P R W Y P C W 1 A Q L G E L C D L D S D D |
| SEQ ID NO: 882 | Y R G W L P C W R A K L G D L C D L G Q P M |
| SEQ ID NO: 883 | G E A W Y P C W L A R L G E L C D M D P R V |

```
SEQ ID NO: 884    W Y P C W M A Q L G E L C D L D E S T R L T

SEQ ID NO: 885    I G S W W P C W M A Q L G E L C D L E P E L

SEQ ID NO: 886    G T T W Y P C W L A Q L G E L C D L D V L E

SEQ ID NO: 887    W W P C W M A Q L G D L C D L E E T S G G T

SEQ ID NO: 888    W Y P C W M A Q L G E L C D L G P T E S N L

SEQ ID NO: 889    W Y P C W M A N L G E L C D L E Y P S W A Q

SEQ ID NO: 890    R G M C Y P C W F A R L G E L C D L E C D Q

SEQ ID NO: 891    W Y P C W M A Q L G E L C D L D A G A R H L

SEQ ID NO: 892    K S G W Y P C W M A K L G E L C D L E A Q P

SEQ ID NO: 893    G P R F Y P C W I A Q L G E L C D L E D M G

SEQ ID NO: 894    R V T W Y P C W M A Q L G E L C D L E E S V

SEQ ID NO: 895    W L P C W M A Q L G D L C D L E Q Y V P L P

SEQ ID NO: 896    Y L P C W M A H L G E L C D L D S P L K A R

SEQ ID NO: 897    W Y P C W M A Q L G E L C D L D D H W P A M

SEQ ID NO: 898    W Y P C W R A Q L G E L C D L D P P I A V E

SEQ ID NO: 899    W Y P C W M A N L G E L C D L E A E R S P V

SEQ ID NO: 900    R D Q Y Y P C W M A Q L G E L C D L D E V F

SEQ ID NO: 901    W Y P C W M A Q L G D L C D L E K P V T E R

SEQ ID NO: 902    W Y P C W I A R L G E L C D L E T S G G F P

SEQ ID NO: 903    S G H C Y P C W L A G L G E L C D L N C G
```

An IL-2Rβ ligand can comprise an amino acid sequence selected from anyone of SEQ ID NOS: 805-903, wherein the amino acid sequence can be terminated with one or more amino acids on the N-terminus, on the C-terminus, or on both the N- and C-termini. For example, an amino acid sequence can include terminal glycines and/or serines. For example, an IL-2Rβ ligand can comprise a -G-G- moiety (SEQ ID NO: 9399) on the N-terminus, on the C-terminus, or on both the N- and C-termini.

An IL-2Rβ ligand can comprise an amino acid sequence selected from anyone of SEQ ID NOS: 805-903, wherein each amino acid independently comprises one or more of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

IL-2Rβ ligands of SEQ ID NOS: 805-903 can bind to the human IL-2Rβ subunit with an $IC_{50}$ of less than 100 μM.

An-IL-2Rβ ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 805-903.

An IL-2Rβ ligand provided by the present disclosure can comprise a truncated amino acid sequence of any one of SEQ ID NOS: 805-903.

An IL-2Rβ ligand provided by the present disclosure can comprise an amino acid sequence selected from any one of SEQ ID NOS: 805-903, or a truncated amino acid sequence of any one of SEQ ID NOS: 805-903, wherein the amino acid sequence can independently comprise from 1 to 4 glycines (G) (SEQ ID NO: 9429) on the N-terminus, on the C-terminus, or on both the N- and C-termini.

An IL-2Rβ ligand provided by the present disclosure can comprise an amino acid sequence selected from any one of SEQ ID NOS: 805-903, or a truncated amino acid sequence of any one of SEQ ID NOS: 805-903, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 805-903 or to a truncated amino acid sequence of any one of SEQ ID NOS: 805-903.

An IL-2Rβ ligand of any one of SEQ ID NOS: 805-903 can bind to the hIL-2Rβ subunit with an $IC_{50}$ of less than 10 µM as determined using phage ELISA competition assays.

An IL-2Rβ ligand of any one of SEQ ID NOS: 805-903, a truncated IL-2Rβ ligand of any one of SEQ ID NOS: 805-903, or a substituted IL-2Rβ ligand of any one of SEQ ID NOS: 805-903 can bind to the hIL-2Rβ subunit with an $IC_{50}$ of less than 100 µM or less than 10 µM as determined using phage ELISA competition assays.

An IL-2Rβ ligand provided by the present disclosure can comprise the amino acid sequence of Formula (2) (SEQ ID NO: 2575), an amino acid sequence of Formula (2a) (SEQ ID NO: 2576), an amino acid sequence of Formula (2b) (SEQ ID NO: 2577), an amino acid sequence of Formula (2c) (SEQ ID NO: 2578), or an amino acid sequence of Formula (2d) (SEQ ID NO: 2579):

$$-X^1-X^2-X^3-C-X^4-X^5-X^6-X^7-X^8-X^9-X^{10}-X^{11}-C-X^{12}-X^{13}-X^{14}- \quad (2)$$

$$-X^2-X^3-C-X^4-X^5-X^6-X^7-X^8-X^9-X^{10}-X^{11}-C-X^{12}-X^{13}- \quad (2a)$$

$$-X^3-C-X^4-X^5-X^6-X^7-X^8-X^9-X^{10}-X^{11}-C-X^{12}- \quad (2b)$$

$$-C-X^4-X^5-X^6-X^7-X^8-X^9-X^{10}-X^{11}-C- \quad (2c)$$

$$-X^4-X^5-X^6-X^7-X^8-X^9-X^{10}-X^{11}- \quad (2d)$$

wherein,
$X^1$ can be selected from E, F, G, I, L, R, S, W, and Y;
$X^2$ can be selected from F, H, K, L, N, Q, S, T, V, W, and Y;
$X^3$ can be selected from E, G, L, P, and S;
$X^4$ can be selected from E, F, G, H, Q, R, S, W, and Y;
$X^5$ can be selected from E, I, K, L, M, N, R, S, T, and V;
$X^6$ can be selected from A, D, G, and Y;
$X^7$ can be selected from A, C, D, E, G, H, K, L, N, Q, R, S, and T;
$X^8$ can be selected from D, F, L, M, P, R, and V;
$X^9$ can be selected from G, R W, and Y;
$X^{10}$ can be selected from A, D, E, Q, W, and Y;
$X^{11}$ can be selected from I, L, Q, V, and Y;
$X^1$ can be selected from D, E, G, H, V, and Y;
$X^1$ can be selected from D, F, H, I, K, L, M, and V; and
$X^{14}$ can be selected from A, D, E, G, H, K, L, N, Q, V, and W.

In an IL-2Rβ ligand of Formula (2)-(2d), $X^1$ can be selected from S, W, and Y.

In an IL-2Rβ ligand of Formula (2)-(2d), $X^1$ can be W.

In an IL-2Rβ ligand of Formula (2)-(2d), $X^2$ can be selected from K, L, W, and Y.

In an IL-2Rβ ligand of Formula (2)-(2d), $X^3$ can be P.

In an IL-2Rβ ligand of Formula (2)-(2d), $X^4$ can be W.

In an IL-2Rβ ligand of Formula (2)-(2d), $X^5$ can be selected from I, L, and M

In an IL-2Rβ ligand of Formula (2)-(2d), $X^6$ can be A.

In an IL-2Rβ ligand of Formula (2)-(2d), $X^7$ can be Q.

In an IL-2Rβ ligand of Formula (2)-(2d), $X^8$ can be L

In an IL-2Rβ ligand of Formula (2)-(2d), $X^9$ can be G

In an IL-2Rβ ligand of Formula (2)-(2d), $X^{10}$ can be selected from D and E.

In an IL-2Rβ ligand of Formula (2)-(2d), $X^{11}$ can be L.

In an IL-2Rβ ligand of Formula (2)-(2d), $X^{12}$ can be selected from D and E.

In an IL-2Rβ ligand of Formula (2)-(2d), $X^{13}$ can be L.

In an IL-2Rβ ligand of Formula (2)-(2d), $X^{14}$ can be selected from D and E.

In an IL-2Rβ ligand of Formula (2)-(2d), the IL-2Rβ ligand can be defined by any combination of $X^1$ to $X^{14}$ as defined in the immediately preceding sixteen (16) paragraphs.

In an IL-2Rβ ligand of Formula (2)-(2d),
$X^1$ can be selected from S, W, and Y;
$X^2$ can be selected from K, L, W, and Y;
$X^3$ can be P;
$X^4$ can be W;
$X^5$ can be selected from I, L, and M;
$X^6$ can be A;
$X^7$ can be Q;
$X^8$ can be L;
$X^9$ can be G;
$X^{10}$ can be selected from D and E;
$X^{11}$ can be L;
$X^1$ can be selected from D and E;
$X^1$ can be L; and
$X^{14}$ can be selected from D and E.

In an IL-2Rβ ligand of Formula (2)-(2d),
$X^1$ can be W;
$X^2$ can be selected from K, L, W, and Y;
$X^3$ can be P;
$X^4$ can be W;
$X^5$ can be selected from I, L, and M;
$X^6$ can be A;
$X^7$ can be Q;
$X^8$ can be L;
$X^9$ can be G;
$X^{10}$ can be selected from D and E;
$X^{11}$ can be L;
$X^{12}$ can be selected from D and E;
$X^{13}$ can be L; and
$X^{14}$ can be selected from D and E.

An IL-2Rβ ligand can comprise the amino acid sequence of any one of SEQ ID NOS: 2580-2655.

| | | |
|---|---|---|
| SEQ ID NO: 2580 | V R A W Y P C W I A R L G E L C D L E V D |
| SEQ ID NO: 2581 | W F P C W M A Q L G E V C D L D |
| SEQ ID NO: 2582 | W Y P C H M A K L R E L C D L D |
| SEQ ID NO: 2583 | S L P C W M A Q L G D L C E L H |
| SEQ ID NO: 2584 | S N P C W M A Q L W E L C D L |
| SEQ ID NO: 2585 | Y K P C W I A Q L G E L C E L |
| SEQ ID NO: 2586 | W Q P C W M A Q L G E L C D L E |
| SEQ ID NO: 2587 | W K P C W L A Q L G D L C E M E |
| SEQ ID NO: 2588 | W L P C W M A K L G D L C E L E |

| | | |
|---|---|---|
| SEQ ID NO: 2589 | W L P C W M A Q L G E L C V M E | |
| SEQ ID NO: 2590 | L H P C W M A Q L G E L C D L E | |
| SEQ ID NO: 2591 | S L P C W M A Q L G E L C D L V | |
| SEQ ID NO: 2592 | W K P C W M A G L G E L C E L D | |
| SEQ ID NO: 2593 | W W P C S S A E L G E I C D F D | |
| SEQ ID NO: 2594 | W Q P C W R A K L G E L C D L E | |
| SEQ ID NO: 2595 | W S P C W I A T L G E L C D L D | |
| SEQ ID NO: 2596 | W N P C W I A Q L G D L C D M V | |
| SEQ ID NO: 2597 | W L P C W L A H L G D I C D L Q | |
| SEQ ID NO: 2598 | W L S P P S Y L P C W M A Q L G E L C D L V | |
| SEQ ID NO: 2599 | W D V H A I R N P C W L A K L G D L C D L D | |
| SEQ ID NO: 2600 | G A G V L H R W P C W M A K L G D L C D L D | |
| SEQ ID NO: 2601 | D T G R D G W K P C W M A L L G E L C E L E | |
| SEQ ID NO: 2602 | E Q G M L G Y F P C W K A L L G D V C D L D | |
| SEQ ID NO: 2603 | W R V T A S L Q P C W M A Q L G E L C D L N | |
| SEQ ID NO: 2604 | G Q V V E T S L P C W E A Q L G E L C V L D | |
| SEQ ID NO: 2605 | T V G Q F E W Y P C S T A Q L G E L C D L D | |
| SEQ ID NO: 2606 | A L V G G T F Y P C Y V A H L G E L C D I E | |
| SEQ ID NO: 2607 | I D R A D G W K P C W I A Q V G E L C V L E | |
| SEQ ID NO: 2608 | Y R R E R V E F P C W L A Q L G E L C D K E | |
| SEQ ID NO: 2609 | A V S H G N W L P C Y I A Q L G E L C D L D | |
| SEQ ID NO: 2610 | I P K G E S W F P C W M A A M G E L C D L E | |
| SEQ ID NO: 2611 | W Y P C W I A Q L G E V C D L E K Q T G S V | |
| SEQ ID NO: 2612 | W Y P C W M A H L G D V C D L E S F G Q T E | |
| SEQ ID NO: 2613 | Y K P C Q M A Q L G E L C D L D V D N K A E | |
| SEQ ID NO: 2614 | F K P C W I A N L G E L C D M D D E R S S E | |
| SEQ ID NO: 2615 | W K P C W M A R L G E L C D I E D T K V N A | |
| SEQ ID NO: 2616 | S L P C W I A R L G E L C D L D G Y D G E E | |
| SEQ ID NO: 2617 | F Y P C W K A R L G E L C E L E E L R G Y Y | |
| SEQ ID NO: 2618 | W K P C W I A D L G E L C D L A P A W H E Y | |
| SEQ ID NO: 2619 | R L P C W R A Q L G D L C E L D W G L D M G | |
| SEQ ID NO: 2620 | S K P C W M A Q L G E L C D L D V W N L Q M | |
| SEQ ID NO: 2621 | G Y P C W L A Q L G D Y C D L D A G A P S W | |
| SEQ ID NO: 2622 | S W P C W M A Q L G D L C D L D G S A G A S | |
| SEQ ID NO: 2623 | W K P C W L A Q L G E L C D L E R P S T T S | |
| SEQ ID NO: 2624 | W Y S C G K A Q L G E L C D L D V E S Q P G | |
| SEQ ID NO: 2625 | Y V P C Y M A R L G E L C E L E A N R P G Q | |
| SEQ ID NO: 2626 | S K P C W L A Q L G D L C D F D W T A A D H | |
| SEQ ID NO: 2627 | W F P C W M A Q L G D L C E L E P D S V P A | |

-continued

| | |
|---|---|
| SEQ ID NO: 2628 | W T P C W I A H L G D L C D L E P Q D D T D |
| SEQ ID NO: 2629 | W K P C F 1 A S L G E L C D L D Q G S V E V |
| SEQ ID NO: 2630 | W K P C W M A A L G E L C D L E R S V G K V |
| SEQ ID NO: 2631 | W K P C W R A Q L G E L C D L E L G P S E R |
| SEQ ID NO: 2632 | F F P C W M G Q L G D L C D L E V R S M Q K |
| SEQ ID NO: 2633 | Y W P C S M A S L G E L C D L E W Q G R L P |
| SEQ ID NO: 2634 | W Y P C Y M A S L G E L C D L Q S S I S P R |
| SEQ ID NO: 2635 | W Y P C W M A Q L G E L C D H E W P S Y G A |
| SEQ ID NO: 2636 | M G S W L P C W M A Q L G D L C D V E G G M |
| SEQ ID NO: 2637 | Q K G F L P C W R A Q L G Q L C D M E S Q Y |
| SEQ ID NO: 2638 | G S G W Q P C W M A D L G E L C D L D N E K |
| SEQ ID NO: 2639 | W R R W Y P C W M A Q L G E L C D L D Q W T |
| SEQ ID NO: 2640 | R R S W Y P C R I A Q L G E L C D L D P R V |
| SEQ ID NO: 2641 | A Y R I Y P C W K A Q L G E L C D L D N A D |
| SEQ ID NO: 2642 | Q R N S F P C W L A Q L G D L C D L G D W A |
| SEQ ID NO: 2643 | Q P A W L P C W L A Q L G E L C D L G T G A |
| SEQ ID NO: 2644 | S R F W Q P C W M A Q L G E L C H L D P Q M |
| SEQ ID NO: 2645 | Y L N F N P C W T A Q L G E L C D L A S G E |
| SEQ ID NO: 2646 | S T G W Y P C W I A E F G E L C D L V K P H |
| SEQ ID NO: 2647 | A H W S Q P C W T A Q L G E L C D L D M G D |
| SEQ ID NO: 2648 | H P V R Y P C W V A Q L G E L C D L E N G N |
| SEQ ID NO: 2649 | Q T G S Y P C W I A H L G E L C D L E G S A |
| SEQ ID NO: 2650 | T G W W Y P C W M A Q L G E L C D L Q Q T |
| SEQ ID NO: 2651 | D L W Q P C W M A R L G E L C D L K G |
| SEQ ID NO: 2652 | M G T G W Q N Y C R Y A Q L G E L C L L |
| SEQ ID NO: 2653 | W Y P C G V A Q P G D L C D L E |
| SEQ ID NO: 2654 | M L G E W L C E M D Q L G Y L C Y L D H G D |
| SEQ ID NO: 2655 | W D G W E C G M D H D G W V C E F W G E |

An IL-2Rβ ligand provided by the present disclosure can comprise a truncated amino acid sequence of any one of SEQ ID NOS: 2575-2655.

An IL-2Rβ ligand provided by the present disclosure can comprise an amino acid sequence selected from any one of SEQ ID NOS: 2575-2655, or a truncated amino acid sequence of any one of SEQ ID NOS: 2575-2655, wherein the amino acid sequence can independently comprise from 1 to 4 glycines (SEQ ID NO: 9429) on the N-terminus, on the C-terminus, or on both the N- and C-termini.

An IL-2Rβ ligand provided by the present disclosure can comprise an amino acid sequence selected from any one of SEQ ID NOS: 2575-2655, or a truncated amino acid sequence of any one of SEQ ID NOS: 2575-2655, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2575-2655 or to a truncated amino acid sequence of any one of SEQ ID NOS: 2575-2655.

An IL-2Rβ ligand of any one of SEQ ID NOS: 2575-655, a truncated IL-2Rβ ligand of any one of SEQ ID NOS: 2575-2655, or a substituted IL-2Rβ ligand of any one of SEQ ID NOS: 2575-2655 can bind to the hIL-2Rβ subunit with an IC$_{50}$ of less than 100 μM or less than 10 μM and to the cyIL-2Rβ subunit with an IC$_{50}$ of less than 100 μM or less than 10 μM as determined using phage ELISA competition assays.

An IL-2Rβ ligand of any one of SEQ ID NOS: 2580-2655 bound to the hIL-2Rβ subunit with an IC$_{50}$ of less than 100 μM as determined using phage ELISA competition assays.

An IL-2Rβ ligand provided by the present disclosure can comprise the amino acid sequence of Formula (3) (SEQ ID NO: 2661), an amino acid sequence of Formula (3a) (SEQ ID NO: 2662), an amino acid sequence of Formula (3b) (SEQ ID NO: 2663), an amino acid sequence of Formula (3c) (SEQ ID NO: 2664), an amino acid sequence of Formula (3d) (SEQ ID NO: 2665), an amino acid sequence of Formula (3e) (SEQ ID NO: 2666):

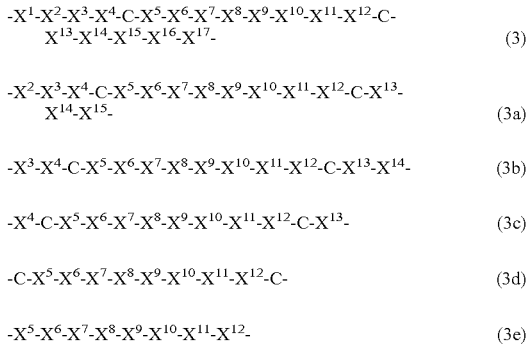

wherein,
$X^1$ can be selected from A, D, E, F, G, H, I, K, L, M, N, P, Q, R, S, T, V, W, and Y;
$X^2$ can be selected from C, D, F, G, I, L, M, R, S, V, W, and Y;
$X^3$ can be selected from A, D, F, H, K, L, N, P, Q, R, S, T, V, W, and Y;
$X^4$ can be selected from A, D, F, L, N, P, Q, S, T, and W;
$X^5$ can be selected from D, E, F, G, L, M, Q, R, S, W, and Y;
$X^6$ can be selected from A, F, I, K, L, M, N, Q, R, S, V, W, and Y;
$X^7$ can be selected from A, D, E, I, S, T, V, and W;
$X^8$ can be selected from A, E, F, G, H, K, L, N, P, Q, R, S, V, W, and Y;
$X^9$ can be selected from A, E, I, L, M, P, Q V, and W;
$X^{10}$ can be selected from F, G, and V;
$X^{11}$ can be selected from D, E, N, P, Q, S, V, W, and Y;
$X^{12}$ can be selected from D, F, H, I, L, M, Q, S, T, V, and W;
$X^{13}$ can be selected from A, D, E, L, N, Q, S, T, and V;
$X^{14}$ can be selected from A, E, F, I, K, L, M, Q, R S, T V, and W;
$X^{15}$ can be selected from A, D, E, F, G, I, K, L, N, P, Q, R, T, V, W, and Y;
$X^{16}$ can be selected from A, C, D, E, F, G, H, I, L, M, N, P, Q, R, S, T, V, W, and Y; and
$X^{17}$ can be selected from A, D, E, F, G, H, I, K, L, M N, P, Q, R, S, T, V, W, and Y.

In an IL-2Rβ ligand of Formula (3)-(3e), $X^1$ can be selected from A, D, E, G, R, S, T, V, and W.
In an IL-2Rβ ligand of Formula (3)-(3e), $X^1$ can be selected from G, R, and W.
In an IL-2Rβ ligand of Formula (3)-(3e), $X^2$ can be selected from F, L, S, V, W, and Y
In an IL-2Rβ ligand of Formula (3)-(3e), $X^2$ can be selected from F and W.
In an IL-2Rβ ligand of Formula (3)-(3e), $X^3$ can be selected from F, H, K, L, N, Q, W, and Y.
In an IL-2Rβ ligand of Formula (3)-(3e), $X^3$ can be selected from F, H, L, W, and Y.
In an IL-2Rβ ligand of Formula (3)-(3e), $X^4$ can be selected from D and P.
In an IL-2Rβ ligand of Formula (3)-(3e), $X^5$ can be selected from F, L, S, W, and Y.
In an IL-2Rβ ligand of Formula (3)-(3e), $X^5$ can be selected from F, W, and Y.
In an IL-2Rβ ligand of Formula (3)-(3e), $X^6$ can be selected from F, I, K, L, M, R, and V.
In an IL-2Rβ ligand of Formula (3)-(3e), $X^6$ can be selected from I, L, and M.
In an IL-2Rβ ligand of Formula (3)-(3e), $X^7$ can be A.
In an IL-2Rβ ligand of Formula (3)-(3e), $X^8$ can be selected from H, K, L, Q, R, and S.
In an IL-2Rβ ligand of Formula (3)-(3e), $X^8$ can be Q.
In an IL-2Rβ ligand of Formula (3)-(3e), $X^9$ can be selected from I, L, and V.
In an IL-2Rβ ligand of Formula (3)-(3e), $X^9$ can be selected from L and V.
In an IL-2Rβ ligand of Formula (3)-(3e), $X^{10}$ can be G.
In an IL-2Rβ ligand of Formula (3)-(3e), $X^{11}$ can be selected from D and E.
In an IL-2Rβ ligand of Formula (3)-(3e), $X^{11}$ can be E.
In an IL-2Rβ ligand of Formula (3)-(3e), $X^{12}$ can be selected from L and V.
In an IL-2Rβ ligand of Formula (3)-(3e), $X^{12}$ can be L.
In an IL-2Rβ ligand of Formula (3)-(3e), $X^{13}$ can be selected from D and E.
In an IL-2Rβ ligand of Formula (3)-(3e), $X^{13}$ can be D.
In an IL-2Rβ ligand of Formula (3)-(3e), $X^{14}$ can be selected from F, I, L, and M.
In an IL-2Rβ ligand of Formula (3)-(3e), $X^{14}$ can be L.
In an IL-2Rβ ligand of Formula (3)-(3e), $X^{15}$ can be selected from D, E, F, G, and V.
In an IL-2Rβ ligand of Formula (3)-(3e), $X^{15}$ can be selected from D, E, F, and G.
In an IL-2Rβ ligand of Formula (3)-(3e), $X^{16}$ can be selected from D, E, G, K, P, V, and W.
In an IL-2Rβ ligand of Formula (3)-(3e), $X^{16}$ can be G.
In an IL-2Rβ ligand of Formula (3)-(3e), $X^{17}$ can be selected from A, E, G, P, Q, S, T, V, and W.
In an IL-2Rβ ligand of Formula (3)-(3e), $X^{17}$ can be G.
In an IL-2Rβ ligand of Formula (3)-(3e), the IL-2Rb ligand can be defined by any combination of $X^1$ to $X^{17}$ as defined in the immediately preceding thirty one (31) paragraphs.

In an IL-2Rβ ligand of Formula (3)-(3e),
$X^1$ can be selected from A, D, E, G, R, S, T, V, and W;
$X^2$ can be selected from F, L, S, V, W, and Y;
$X^3$ can be selected from F, H, K, L, N, Q, W, and Y;
$X^4$ can be selected from D and P;
$X^5$ can be selected from F, L, S, W, and Y;
$X^6$ can be selected from F, I, K, L, M, R, and V;
$X^7$ can be A;
$X^8$ can be selected from H, K, L, Q, R, and S;
$X^9$ can be selected from I, L, and V;
$X^{10}$ can be G;
$X^{11}$ can be selected from D and E;
$X^{12}$ can be selected from L and V;
$X^{13}$ can be selected from D and E;
$X^{14}$ can be selected from F, I, L, and M;
$X^{15}$ can be selected from D, E, F, G, and V;
$X^{16}$ can be selected from D, E, G, K, P, V, and W;
$X^{17}$ can be selected from A, E, G, P, Q, S, T, V, and W.
In an IL-2Rβ ligand of Formula (3)-(3e),
$X^1$ can be selected from G, R, and W;
$X^2$ can be selected from F and W;
$X^3$ can be selected from F, H, L, W, and Y;
$X^4$ can be selected from D and P;
$X^5$ can be selected from F, W, and Y;
$X^6$ can be selected from I, L, and M;
$X^7$ can be A;

$X^8$ can be Q;
$X^9$ can be selected from L and V;
$X^{10}$ can be G;
$X^{11}$ can be E;
$X^{12}$ can be L;
$X^{13}$ can be D;
$X^{14}$ can be L;
$X^{15}$ can be selected from D, E, F, and G;
$X^{16}$ can be G; and
$X^{17}$ can be G.

An IL-2Rβ ligand can comprise the amino acid sequence of anyone of SEQ ID NO: 2667-2891.

| | |
|---|---|
| SEQ ID NO: 2667 | W Y P C W I A Q L G E L C D L D A K G Q R R |
| SEQ ID NO: 2668 | T N N F Y P C W L A K L G D L C D F D D L N |
| SEQ ID NO: 2669 | W Y P C W I A R V G E L C D L E E G P V N R |
| SEQ ID NO: 2670 | A V E F Y P C W L A R I G E L C D L V E P |
| SEQ ID NO: 2671 | W Y P C W I A H L G E L C D L E |
| SEQ ID NO: 2672 | W Y P C W I A R V G E L C D M E |
| SEQ ID NO: 2673 | R R E W Y P C W I A Q V G E L C D L P L I |
| SEQ ID NO: 2674 | R W P W Y P C E I A R I G E L C D L E Q A N |
| SEQ ID NO: 2675 | F G A F Y P C W K A Q L G E L C D L E P V T |
| SEQ ID NO: 2676 | H G R W F P C W M A Q V G D L C D L E H S N |
| SEQ ID NO: 2677 | W Y P C W L A K L G E L C D L D R A E A L P |
| SEQ ID NO: 2678 | V W F P C W F A Q L G D L C D L D Q D P |
| SEQ ID NO: 2679 | E T L G S V W Y P C W I A S I G E L C D L D |
| SEQ ID NO: 2680 | W Y S C W I A Q L G E L C D L D D M G D R V |
| SEQ ID NO: 2681 | W F P C W L A Q L G E L C D K E |
| SEQ ID NO: 2682 | W Y P C W I A Q L G E L C D L V |
| SEQ ID NO: 2683 | S H L W F P C W M A Q L G E L C D L E G G P |
| SEQ ID NO: 2684 | R R W L P C W M A H V G E L C D L E L G N |
| SEQ ID NO: 2685 | Y W C W F A R V G E L C D L D D G G V P S |
| SEQ ID NO: 2686 | W Y S C W I A Q I G E L C D L E |
| SEQ ID NO: 2687 | M N P V G T F Y P C W I A K L G E L C D L Q |
| SEQ ID NO: 2688 | H G G V I G W Y P C W M A K V G E L C D L D |
| SEQ ID NO: 2689 | W Y P C S I A L L G E L C D L E S V H E K S |
| SEQ ID NO: 2690 | E Q R N R Q W W P C W L A R L G D L C D L D |
| SEQ ID NO: 2691 | W Y P C W L A Q L G E L C D L D |
| SEQ ID NO: 2692 | W L P C W M A H L G D L C D L E |
| SEQ ID NO: 2693 | R P S W A P C W L A Q V G E L C D L D H P E |
| SEQ ID NO: 2694 | E S K E P A F W P C W M A Q L G D L C D L E |
| SEQ ID NO: 2695 | R S L R E S W F P C W M A K L G D L C D L E |
| SEQ ID NO: 2696 | W H P C W L A R V G D L C D L D |
| SEQ ID NO: 2697 | S R S A G E Y Y P C W L A Q L G E L C D L A |
| SEQ ID NO: 2698 | R Q V P K Q W |
| SEQ ID NO: 2699 | W Y P C W |
| SEQ ID NO: 2700 | Q V M R L W Y P C W M A Q L G E L C D L E |
| SEQ ID NO: 2701 | W Y P C W M A Q L G E L C D L D E A P V Q P |
| SEQ ID NO: 2702 | R D I W W P C W V A Q L G E L C D L D D P Q |
| SEQ ID NO: 2703 | S A T W Y P C F L A N L G E L C D L E Q E N |

-continued

| SEQ ID NO: 2704 | Y A E W Y P C W M A R V G E V C D L E V T P |
| SEQ ID NO: 2705 | R S G D K A F F P C W L A Q L G D L C D L D |
| SEQ ID NO: 2706 | W Y P C W M A Q L G E L C D M D |
| SEQ ID NO: 2707 | R V S Y P C W L A R L G E L C D M D L E E |
| SEQ ID NO: 2708 | T E S W Y P C W L A N L G D L C D L E W S A |
| SEQ ID NO: 2709 | W L P C W M A D V G D L C D L D |
| SEQ ID NO: 2710 | W H P C W M A R L G E L C D L D |
| SEQ ID NO: 2711 | Q G T K W H W N P C W M A Q L G E L C D L D |
| SEQ ID NO: 2712 | K N G P K S W Y P C W M A Q V G D L C D L D |
| SEQ ID NO: 2713 | S G T G P A W Y P C F L A S L G Q L C D L E |
| SEQ ID NO: 2714 | W Y P C W M A R M G E L C D L E |
| SEQ ID NO: 2715 | W L P C W R A Q L G Q L C D L D |
| SEQ ID NO: 2716 | L F P C W L A Q L G E L C D L E |
| SEQ ID NO: 2717 | R Y P C W I A Q L G E L C D L D |
| SEQ ID NO: 2718 | W H P C W I A H L G E L C D L E |
| SEQ ID NO: 2719 | M Y P C W I A H L G E L C D L D |
| SEQ ID NO: 2720 | W Y P C S I A S L G E L C D L E |
| SEQ ID NO: 2721 | W L P C Y M A Q L G D L C D L E |
| SEQ ID NO: 2722 | W H P C W M A Q V G E V C D L D |
| SEQ ID NO: 2723 | W Y P C W L A S L G E V C D L E |
| SEQ ID NO: 2724 | W W P C S I A R L G Q L C D L D |
| SEQ ID NO: 2725 | W Y P C W L A H L G E L C D L A |
| SEQ ID NO: 2726 | W Y P C W L A Q L G E L C D A E |
| SEQ ID NO: 2727 | W K P C W M A L L G E L C D L E |
| SEQ ID NO: 2728 | R Y P C W R A K L G E L C D L D |
| SEQ ID NO: 2729 | E E Q S R G F L P C W M A L L G E L C D L D |
| SEQ ID NO: 2730 | L G S K R Q W Y P C W V A H L G E L C D L E |
| SEQ ID NO: 2731 | E S E G R G W Y P C W N A L L G E L C D L E |
| SEQ ID NO: 2732 | R W T Q A Q W Y P C W L A Q L G E L C D L E |
| SEQ ID NO: 2733 | L H A G R W N P C W L A Q L G E L C D L E |
| SEQ ID NO: 2734 | L S S K G W Y P C W K A R L G D L C D L E |
| SEQ ID NO: 2735 | D M F T H R W Y P C S M A K L G E L C D L E |
| SEQ ID NO: 2736 | M T D R A F W N P C W V A R L G E L C D L D |
| SEQ ID NO: 2737 | N V T Y T Q W F P C W L A R L G E L C D L V |
| SEQ ID NO: 2738 | V R T R I W Y P C W S A Q L G E L C D L D |
| SEQ ID NO: 2739 | A M A R R Y L P C W I A K L G E L C E L D |
| SEQ ID NO: 2740 | A R G E Y R W F P C W M A R L G E L C D L E |
| SEQ ID NO: 2741 | Y L E R S R W Y P C F I A Q L G E L C D L E |
| SEQ ID NO: 2742 | F R V S R D W F P C W M A Q L G E V C D L E |

-continued

| | |
|---|---|
| SEQ ID NO: 2743 | I E R A W E |
| SEQ ID NO: 2744 | V A S E R |
| SEQ ID NO: 2745 | W Y P C W I A K L G E V C D L D Q G T T R Q |
| SEQ ID NO: 2746 | W Y P C W L A H L G E L C D L D W K G R N D |
| SEQ ID NO: 2747 | W Y P C W R A Q L G E L C D L V D L G S H L |
| SEQ ID NO: 2748 | W S P C W M A S L G D L C D L E E T R Q T E |
| SEQ ID NO: 2749 | W T P C W I A Q L G E L C D L E G R H G T V |
| SEQ ID NO: 2750 | L P C W I A Q L G D L C D L E P E P S P E |
| SEQ ID NO: 2751 | F Y P C W A A H L G D L C D L E Y Q E A G P |
| SEQ ID NO: 2752 | W L P C W L A P L G D L C D M D M S A V M N |
| SEQ ID NO: 2753 | W R P C W M A H L G D L C D L E M A N E N P |
| SEQ ID NO: 2754 | W Y P C W L A Q L G E V C D L D D G G G V F |
| SEQ ID NO: 2755 | W W P C W L A Q L G E L C D L E V N G S L I |
| SEQ ID NO: 2756 | T E M W Y P C W M A Y Q G E L C D L D M T Y |
| SEQ ID NO: 2757 | A R T W W P C W R A K L G E L C D L V V P E |
| SEQ ID NO: 2758 | H Q G F Y S C R L A R L G E L C D L D T G W |
| SEQ ID NO: 2759 | V D E F Y P C S M A G L G E L C D L E R Q N |
| SEQ ID NO: 2760 | A W D W Y P C S V A A L G E I C D L D I Q D |
| SEQ ID NO: 2761 | R P P W Y P C W M A R L G E V C D M D I M L |
| SEQ ID NO: 2762 | S Q R W Y P C W V A H L G E L C D L E G V V |
| SEQ ID NO: 2763 | K G S W Q P C W F A K L G E L C D L H P T S |
| SEQ ID NO: 2764 | Q T W Y L P C W M A K L G E L C D L G E R D |
| SEQ ID NO: 2765 | E P R W Y P C W M A Q M G E L C D M E M S D |
| SEQ ID NO: 2766 | W G G R Y W C W M A K L G D L C D L E D E W |
| SEQ ID NO: 2767 | W W P C W I A Q V G E L C D L D G P G R P T |
| SEQ ID NO: 2768 | R L V Y D C L F A Q V G D L C E V I S |
| SEQ ID NO: 2769 | W R I L W M Q Q C W R S H V V N Q C A L |
| SEQ ID NO: 2770 | W Y P C W I A Q V G E L C D L D E V S H G R |
| SEQ ID NO: 2771 | T G E W W P C W V A E V G E L C D L E R G P |
| SEQ ID NO: 2772 | A R T Q G W Y D C L F A Q V G E L C D L |
| SEQ ID NO: 2773 | F H P C W R A L L G E L C D L E T A L G P S |
| SEQ ID NO: 2774 | L Q I R K L W A C R I D L V G P F C L L |
| SEQ ID NO: 2775 | A E Y S G R Y D C Y I A K V G E L C D I |
| SEQ ID NO: 2776 | S W R F L W Q D C G R A H V G E L C D L |
| SEQ ID NO: 2777 | N R W W H P C W M A R V G E L C D L E P D A |
| SEQ ID NO: 2778 | W W P C W V A K L G E L C D L E G D A S R V |
| SEQ ID NO: 2779 | W Y P C E F A Q L G E L C D L L P F Y P A |
| SEQ ID NO: 2780 | S Y M H D C F M A Q V G D L C D R F I S |
| SEQ ID NO: 2781 | W W P C W I A Q V G E L C D L E E E S R E S |
| SEQ ID NO: 2782 | K W A W N P C Y I A R L G E L C D L V E P E |

-continued

| | |
|---|---|
| SEQ ID NO: 2783 | W W P C W I A D L G E L C D L E G P P R G R |
| SEQ ID NO: 2784 | P T L I T W Y D C L F A E V G E L C D M |
| SEQ ID NO: 2785 | E 1 S N W F L D C M F A D V G D L C D L |
| SEQ ID NO: 2786 | A Q V W Y P C W L A K V G E L C D L D Q W N |
| SEQ ID NO: 2787 | F G G K M D W Y P C W I A N L G E L C D L K |
| SEQ ID NO: 2788 | W F P C W M A K V G D |
| SEQ ID NO: 2789 | M G D S S S W F P |
| SEQ ID NO: 2790 | M F R Y Y P C W I A S I G E L C D L E W G V |
| SEQ ID NO: 2791 | E R R W Y P C W L A S V G E L C D L D M G D |
| SEQ ID NO: 2792 | W Y P C W V A Q L G E L C D L E |
| SEQ ID NO: 2793 | R W D Y W P C Y I A Q V G E L C D L E V Y E |
| SEQ ID NO: 2794 | S L A H R S W Y P C W L A Q V G E L C D L D |
| SEQ ID NO: 2795 | Q N A S K G W Y P C W I A H V G E L C D W D |
| SEQ ID NO: 2796 | H R W Y P C W L A H L G E L C D L D P M S |
| SEQ ID NO: 2797 | F Y P C W I A F V G E L C D L E |
| SEQ ID NO: 2798 | E G H W Y P C W I A Q L G E L C D L D W |
| SEQ ID NO: 2799 | W T G W S A F Y P C S I A N L G E L C D L D |
| SEQ ID NO: 2800 | W E K L Q N W Y P C W I A Q M G E L C D L E |
| SEQ ID NO: 2801 | T N G V L D W W P C W M A Q V G E L C D L D |
| SEQ ID NO: 2802 | W Y P C W V A K L G E L C D L E |
| SEQ ID NO: 2803 | A Y Y P C E L A Q L G E L C D L Y N I |
| SEQ ID NO: 2804 | W Y P C W M A H L G E L C D L E |
| SEQ ID NO: 2805 | N D H T A W W P C Y F A Q V G D L C D L V |
| SEQ ID NO: 2806 | W W P C E I A Q I G E L C D L E W V R H A E |
| SEQ ID NO: 2807 | W W P C D F A Q I G E L C D L G P R F T G E |
| SEQ ID NO: 2808 | R D W W L P C E F A L I G E L C D L E R S W |
| SEQ ID NO: 2809 | M R T T F W Y D C Y I A Q V G E L C D F |
| SEQ ID NO: 2810 | S W H A E T W Y P C W L A Q V G E L C D L D |
| SEQ ID NO: 2811 | E W F H D C F L A K V G D L C D L F L W |
| SEQ ID NO: 2812 | S G K T Q M W N P C Y V A K V G E L C D L V |
| SEQ ID NO: 2813 | D K A G P N F Y P C W L A H V G E L C D Q A |
| SEQ ID NO: 2814 | A G F R G R W W P C E Y A Q V G E L C D L E |
| SEQ ID NO: 2815 | W F P C W L A K V G E L C D R D D L A G P S |
| SEQ ID NO: 2816 | W W P C E W A R I G E L C D L E |
| SEQ ID NO: 2817 | K G S S W F P C Y F A Q V G D L C D L Y |
| SEQ ID NO: 2831 | W Y P C W L A Q V G E L C D R E |
| SEQ ID NO: 2819 | R G V Y F P C W L A K V G D L C D S D E F |
| SEQ ID NO: 2820 | R A W W W P C E L A Q V G E L C D L E P S S |
| SEQ ID NO: 2821 | W Y P C W L A K V G E L C D Q E |

-continued

| SEQ ID NO: 2822 | R Y V P D C L K A Q V G D L C D F F A W |
| --- | --- |
| SEQ ID NO: 2823 | W W P C Y L A Q I G E L C D L V |
| SEQ ID NO: 2824 | W Y P C W M A K V G E L C D M E |
| SEQ ID NO: 2825 | Q I T D S G W Y P C W V A K V G E L C D M D |
| SEQ ID NO: 2826 | Y R W W Y P C D I A Q V G E L C D L D Y L L |
| SEQ ID NO: 2827 | C Y M H D C F M A Q V G D L C D R F I S |
| SEQ ID NO: 2828 | W L P C W I A K I G D L C D L D |
| SEQ ID NO: 2829 | S R V W H P C W L A R V G E L C D L E V S D |
| SEQ ID NO: 2830 | W E H E F T W Y P C W I A Q V G E L C D M D |
| SEQ ID NO: 2831 | H R G W V G W Y P C E Y A L P G Q L C D L E |
| SEQ ID NO: 2832 | W Y P C W L A Q L G E L C D Q D W D T P S |
| SEQ ID NO: 2833 | R V R R H |
| SEQ ID NO: 2834 | D G W W P |
| SEQ ID NO: 2835 | L P F Q |
| SEQ ID NO: 2836 | R W M F D C L F A R V G E L C D I R P W |
| SEQ ID NO: 2837 | G G Y Y D C L I A E V G E L C D M P G Q |
| SEQ ID NO: 2838 | V V C Y A C D I A H V G E L C D L T C R |
| SEQ ID NO: 2839 | T P W Y D C Y I A N V G D L C D F A S A |
| SEQ ID NO: 2840 | L E S L D C F F A R 1 G D L C E I W D V |
| SEQ ID NO: 2841 | W Q I F D C Y L A Q V G E L C D L Q D T |
| SEQ ID NO: 2842 | G R Y P D C Y I A H V G E L C E F Y D G |
| SEQ ID NO: 2843 | F G D D F C R F I P L F E M C T T D V E |
| SEQ ID NO: 2844 | L V Y Y D C Y M A Q V G E L C D L P S L |
| SEQ ID NO: 2845 | V S R Y D C Y I A K V G E L C D F F E F |
| SEQ ID NO: 2846 | V T V Q D C Y F A R V G D L C D L F S P |
| SEQ ID NO: 2847 | W E W Y D C L M A Q V G E L C D F E G N |
| SEQ ID NO: 2848 | W A F Y D C R N A Q V G D F C D L W E F |
| SEQ ID NO: 2849 | S M D Q D C Y F A Q V G E L C V L F N Q |
| SEQ ID NO: 2850 | G G Y Y D C L I A E V G E L C D I Y G R |
| SEQ ID NO: 2851 | S N W H D C L F A Q V G E L C D L P G S |
| SEQ ID NO: 2852 | Y D C Y I A Q V G E L C D I |
| SEQ ID NO: 2853 | S W L S D L Q D C Y I A Q V G D L C Q I |
| SEQ ID NO: 2854 | |
| SEQ ID NO: 2855 | R L A S D W W D C Y I A K V G E L C D F |
| SEQ ID NO: 2856 | R L L R D C F L A K V G D L C E L F V W |
| SEQ ID NO: 2857 | Q W F H N C F L A R V G D T C D L F L W |
| SEQ ID NO: 2858 | E L L V D C F K V K V G E L C D L F F G |
| SEQ ID NO: 2859 | R Y V H D C F I A Q V G D L C D L F L H |
| SEQ ID NO: 2860 | K W V H D C F L A K V G D V C D L F V V |
| SEQ ID NO: 2861 | R S L V D C F L V K V G D L C D F F N W |

-continued

| SEQ ID NO: 2862 | R Y L Y D C F L A L V G D L C V K F H Q |
| --- | --- |
| SEQ ID NO: 2863 | A H F Y D C F W A K A G E L C D L W P S |
| SEQ ID NO: 2864 | K W F H D C F L A K V G D L C D L F L W |
| SEQ ID NO: 2865 | W G K L V R D C F L A K V G D L C D L F L W |
| SEQ ID NO: 2866 | T H V H D C F L A K V G D L C D L F I V |
| SEQ ID NO: 2867 | H W V R D C F L A K V G E L C D L F L W |
| SEQ ID NO: 2868 | H G I L D C Y F A K V G E L C E L F D W |
| SEQ ID NO: 2869 | Q F V K D C F L A Q V G D L C E L F L W |
| SEQ ID NO: 2870 | D W L P D C Y F A N V G D L C S L F G S |
| SEQ ID NO: 2871 | H W F L D C F L A N V G D L C D F F G N |
| SEQ ID NO: 2872 | N W L P D C L F A N V G E L C D I F P W |
| SEQ ID NO: 2873 | E I F K D C L F A N V G E L C E I F P S |
| SEQ ID NO: 2874 | N W F H D C F L A R V G D L C D L F L D |
| SEQ ID NO: 2875 | Y S F K D C Y F A K V G E L C E L F L W |
| SEQ ID NO: 2876 | E F F H D C Y V A R V G E L C D L F G W |
| SEQ ID NO: 2877 | S Y L C W L D H W G V I C E E D |
| SEQ ID NO: 2878 | W Y T C M |
| SEQ ID NO: 2879 | Q M V W W D C W S T Q E G P V |
| SEQ ID NO: 2880 | Y W C S V W Q L G S V C E M N |
| SEQ ID NO: 2881 | W T C W L T Q L G Y D C N L D |
| SEQ ID NO: 2882 | D G S W Y T C W F T Q L G E W |
| SEQ ID NO: 2883 | E F W G W Q C W Q E P L G W S |
| SEQ ID NO: 2884 | W Y P C W I A R V G E L C D L |
| SEQ ID NO: 2885 | W Y P C W L A Q V G E L C D L |
| SEQ ID NO: 2886 | L V D C F K V K V G E L C D L |
| SEQ ID NO: 2887 | V H D C F I A Q V G D L C D L |
| SEQ ID NO: 2888 | W P C W A A L G E L C D L D |
| SEQ ID NO: 2889 | W P C W A L G E L C D L D |
| SEQ ID NO: 2890 | W P C W L G E L C D L D |
| SEQ ID NO: 2891 | W Y P C W G E L C D L D |

An IL-2Rβ ligand provided by the present disclosure can comprise a truncated amino acid sequence of any one of SEQ ID NOS: 2661-2891.

An IL-2Rβ ligand provided by the present disclosure can comprise an amino acid sequence selected from any one of SEQ ID NOS: 2661-2891, or a truncated amino acid sequence of any one of SEQ ID NOS: 2661-2891, wherein the amino acid sequence can independently comprise from 1 to 4 glycines (G) (SEQ ID NO: 9429) on the N-terminus, on the C-terminus, or on both the N- and C-termini.

An IL-2Rβ ligand provided by the present disclosure can comprise an amino acid sequence selected from any one of SEQ ID NOS: 2661-2891, or a truncated amino acid sequence of any one of SEQ ID NOS: 2661-2891, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2661-2891 or to a truncated amino acid sequence of any one of SEQ ID NOS: 2661-2891.

An IL-2Rβ ligand of anyone of SEQ ID NOS: 2661-2891, a truncated IL-2Rβ ligand of anyone of SEQ ID NOS: 2661-2891, or a substituted IL-2Rβ ligand of any one of SEQ ID NOS: 2661-2891 can bind to the hIL-2Rβ subunit with an $IC_{50}$ of less than 100 μM or less than 10 μM and to the cynoIL-2Rβ subunit with an $IC_{50}$ of less than 100 μM or less than 10 μM as determined using phage ELISA competition assays.

An IL-2Rβ ligand of any one of SEQ ID NOS: 2667-2891 bound to the hIL-2Rβ subunit with an $IC_{50}$ of less than 100 μM as determined using phage ELISA competition assays.

An IL-2Rβ ligand provided by the present disclosure can comprise the amino acid sequence of Formula (4) (SEQ ID NO: 2900), an amino acid sequence of Formula (4a) (SEQ ID NO: 2901), an amino acid sequence of Formula (4b) (SEQ ID NO: 2902), an amino acid sequence of Formula (4c) (SEQ ID NO: 2903), an amino acid sequence of Formula (4d) (SEQ ID NO: 2904), an amino acid sequence of Formula (4e) (SEQ ID NO: 2905), or an amino acid sequence of Formula (4f) (SEQ ID NO: 2906):

$$-X^1-X^2-X^3-X^4-X^5-C-X^6-X^7-X^8-X^9-X^{10}-X^{11}-X^{12}-X^{13}-C-X^{14}-X^{15}-X^{16}-X^{17}-X^{18}- \quad (4)$$

$$-X^2-X^3-X^4-X^5-C-X^6-X^7-X^8-X^9-X^{10}-X^{11}-X^{12}-X^{13}-C-X^{14}-X^{15}-X^{16}-X^{17}- \quad (4a)$$

$$-X^3-X^4-X^5-C-X^6-X^7-X^8-X^9-X^{10}-X^{11}-X^{12}-X^{13}-C-X^{14}-X^{15}-X^{16}- \quad (4b)$$

$$-X^4-X^5-C-X^6-X^7-X^8-X^9-X^{10}-X^{11}-X^{12}-X^{13}-C-X^{14}-X^{15}- \quad (4c)$$

$$-X^5-C-X^6-X^7-X^8-X^9-X^{10}-X^{11}-X^{12}-X^{13}-C-X^{14}- \quad (4d)$$

$$-C-X^6-X^7-X^8-X^9-X^{10}-X^{11}-X^{12}-X^{13}-C- \quad (4e)$$

$$-X^6-X^7-X^8-X^9-X^{10}-X^{11}-X^{12}-X^{13}- \quad (4f)$$

wherein, $X^1$ can be selected from A, D, E, H, K, N, Q, R, and T;

$X^2$ can be selected from F, G, H, I, L, S, W, and Y;

$X^3$ can be selected from F, I, L, and V;

$X^4$ can be selected from H. K, L, P, R, V, and Y;

$X^5$ can be D;

$X^6$ can be selected from F, L, and Y;

$X^7$ can be selected from F, I, K, L, V, and W;

$X^8$ can be selected from A and V;

$X^9$ can be selected from K, L, N, Q, and R;

$X^{10}$ can be selected from A and V;

$X^{11}$ can be G;

$X^{12}$ can be selected from D and E $X^{13}$ can be selected from L, T, and V;

$X^{14}$ can be selected from D, E, S, and V;

$X^{15}$ can be selected from F, I, K, and L;

$X^{16}$ can be selected from F and W;

$X^{17}$ can be selected from D, F, G, I, L, N, P, V; and $X^{18}$ can be selected from D, G, H, N, Q, S V, and W.

In an IL-2Rβ ligand of Formula (4)-(4e), $X^2$ can be W.

In an IL-2Rβ ligand of Formula (4)-(4e), $X^6$ can be F.

In an IL-2Rβ ligand of Formula (4)-(4e), $X^7$ can be selected from F and L

In an IL-2Rβ ligand of Formula (4)-(4e), $X^8$ can be A.

In an IL-2Rβ ligand of Formula (4)-(4e), $X^9$ can be K.

In an IL-2Rβ ligand of Formula (4)-(4e), $X^{10}$ can be V.

In an IL-2Rβ ligand of Formula (4)-(4e), $X^{13}$ can be L.

In an IL-2Rβ ligand of Formula (4)-(4e), $X^{14}$ can be D.

In an IL-2Rβ ligand of Formula (4)-(4e), $X^{15}$ can be L.

In an IL-2Rβ ligand of Formula (4)-(4e), $X^{16}$ can be F.

In an IL-2Rβ ligand of Formula (4)-(4e), $X^{17}$ can be L.

In an IL-2Rβ ligand of Formula (4)-(4e), $X^{18}$ can be W.

In an IL-2Rβ ligand of Formula (4)-(4e), the IL-2Rb ligand can be defined by any combination of $X^1$ to $X^{18}$ as defined in the immediately preceding twelve (12) paragraphs.

An IL-2Rβ ligand can comprise the amino acid sequence of any one of SEQ ID NO: 2907-2926.

| | |
|---|---|
| SEQ ID NO: 2907 | A F F H D C F F A K A G D L C D F F D D |
| SEQ ID NO: 2908 | D F F H D C F F A K V G D L C D F F F G |
| SEQ ID NO: 2909 | E G F H D C F F A K V G D L C D I F G H |
| SEQ ID NO: 2910 | E H F H D C F F A K V G D L C D I F G N |
| SEQ ID NO: 2911 | E H F H D C F F A K V G D L C D K F G Q |
| SEQ ID NO: 2912 | H I F H D C F I A K V G D L C D L F H S |
| SEQ ID NO: 2913 | H L F H D C F K A K V G D L C D L F I S |
| SEQ ID NO: 2914 | H L F K D C F L A K V G D L C D L F L S |
| SEQ ID NO: 2915 | W G K S I K D C F L A K V G D L C D L F L V |
| SEQ ID NO: 2916 | K S L K D C F L A K V G D L C D L F L V |
| SEQ ID NO: 2917 | K W L L D C F L A L V G D L C D L F L W |
| SEQ ID NO: 2918 | N W L L D C F L A N V G D L C D L F L W |
| SEQ ID NO: 2919 | N W L P D C F L A N V G E L C D L F L W |
| SEQ ID NO: 2920 | Q W L P D C F L A N V G E L C D L F L W |
| SEQ ID NO: 2921 | Q W V R D C L L A N V G E L C E L F L W |
| SEQ ID NO: 2922 | R W V R D C L L A Q V G E L C E L F N W |
| SEQ ID NO: 2923 | R W V V D C Y L A Q V G E L C E L F P W |
| SEQ ID NO: 2924 | R W V V D C Y L A R V G E L C E L F P W |

-continued

```
SEQ ID NO: 2925    T Y V Y D C Y V V R V G E T C S L F P W

SEQ ID NO: 2926    Y Y V Y N C Y W V R V G E V C V L W V W
```

An IL-2Rβ ligand provided by the present disclosure can comprise a truncated amino acid sequence of any one of SEQ ID NOS: 2900-2926.

An IL-2Rβ ligand provided by the present disclosure can comprise an amino acid sequence selected from any one of SEQ ID NOS: 2900-2926, or a truncated amino acid sequence of any one of SEQ ID NOS: 2900-2926, wherein the amino acid sequence can independently comprise from 1 to 4 glycines (G) (SEQ ID NO: 9429) on the N-terminus, on the C-terminus, or on both the N- and C-termini.

An IL-2Rβ ligand provided by the present disclosure can comprise an amino acid sequence selected from any one of SEQ ID NOS: 2900-2926, or a truncated amino acid sequence of any one of SEQ ID NOS: 2900-2926, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2900-2926 or to a truncated amino acid sequence of any one of SEQ ID NOS: 2900-2926.

An IL-2Rβ ligand of any one of SEQ ID NOS: 2900-2926, a truncated IL-2Rβ ligand of any one of SEQ ID NOS: 2900-2926, or a substituted IL-2Rβ ligand of any one of SEQ ID NOS: 2900-2926 can bind to the hIL-2Rβ subunit with an $IC_{50}$ of less than 100 μM or less than 10 μM as determined using phage ELISA competition assays.

An IL-2Rβ ligand of any one of SEQ ID NOS: 2907-2926 bound to the hIL-2Rβ subunit with an $IC_{50}$ of less than 100 μM as determined using phage ELISA competition assays.

Certain IL-2Rβ ligands having SEQ ID NOS: 2575-2655, 2661-2891, 2900-2986, and 2929-2939 bound to the hIL-2Rβ subunit with an $IC_{50}$ of less than 100 μM and to the cyno-IL-2Rβ subunit with an $IC_{50}$ of less than 100 μM as determined using phage ELISA competition assays.

An IL-2Rβ ligand can have the amino acid sequence of any of SEQ ID NOS: 911-930, 2929-2939, 9301 and 9308:

```
SEQ ID NO: 911     G G Y D C R I A Q V G E L C D L G G

SEQ ID NO: 912     G V Q Y K K C W M A Q L G D L C E L D P S G G

SEQ ID NO: 913     G G Y P C W M A Q L G E L C D L G G R R

SEQ ID NO: 9301    G G W Y P C W M A Q L G E L C D L D G G

SEQ ID NO: 915     G G W Y P C W M A Q L G E L C D L D G G R R

SEQ ID NO: 916     G G Y P C H M A Q L G E L C D L W S W G D I G G R R

SEQ ID NO: 917     F Y P C W T A L L G E L C D L E P G P P A M G G

SEQ ID NO: 918     W R R W Y P C W V A Q V G E L C D L E I E A G G

SEQ ID NO: 919     R Q R W Y P C W M A R L G E L C D L D E P T G G

SEQ ID NO: 920     W Y P C W M A Q L G D L C D L E K P V T E R G G

SEQ ID NO: 9308    G G W Y P C W M A Q L G E L C D L D

SEQ ID NO: 921     G G F Y P C W T A L L G E L C D L E P G P P A M G G

SEQ ID NO: 922     G G W G T T W R W Y P C W M A Q L G E L C D L E G G

SEQ ID NO: 923     G G D V L G D R W Y P C W I A K G E L C D L D G G

SEQ ID NO: 924     G G W P C W I A Q L G E L C D L D G G

SEQ ID NO: 925     G G W Y P C W L A K L G E L C D L D G G

SEQ ID NO: 926     G G W Y P C W M A Q L G D L C D L E K P V T E R G G

SEQ ID NO: 927     G G W R R W Y P C W V A Q V G E L C D L E I E A G G

SEQ ID NO: 928     G G R Q R W Y P C W M A R L G E L C D L D E P T G G

SEQ ID NO: 929     G G V Q Y K K C W M A Q L G D L C E L D P S G G

SEQ ID NO: 930     G G Y P C H M A Q L G E L C D L W S W G D I G G

SEQ ID NO: 2930    G G W Y P C W I A R V G E L C D L E E G P V N R

SEQ ID NO: 2931    G G A V E F Y P C W L A R I G E L C D L V E P
```

-continued

| SEQ ID NO: 2932 | G G W Y P C W I A R V G E L C D M E |
| SEQ ID NO: 2933 | G G E W F H D C F L A K V G D L C D L F L G G E W |
| SEQ ID NO: 2934 | G G R Y V H D C F I A Q V G D L C D L F L H |
| SEQ ID NO: 2935 | G G R S L V D C F L V K V G D L C D F F N W |
| SEQ ID NO: 2936 | G G W Y P C W I A R V G E L C D L E |
| SEQ ID NO: 2937 | G G W Y P C W L A Q V G E L C D L D |
| SEQ ID NO: 2938 | G G L V D C F K V K V G E L C D L F |
| SEQ ID NO: 2939 | G G W Y S C W M A Q L G E L C D L D |

An IL-2Rβ ligand can be selected from anyone of IL-2Rβ ligands (BL1)-(BL12) and can have SEQ ID NO: 612, 664, 671, 865, 856, 858, 864, 869, 870, 874, 875, or 901, as shown in Table 1.

TABLE 1

IL-2Rβ Ligands.

| (BL1) | SEQ ID NO: 671 | V Q Y K K C W M A Q L G D L C E L D P S |
| (BL2) | SEQ ID NO: 664 | Y P C H M A Q L G E L C D L W S W G D I |
| (BL3) | SEQ ID NO: 612 | Y P C W M A Q L G E L C D L |
| (BL4) | SEQ ID NO: 865 | W Y P C W M A Q L G E L C D L D |
| (BL5) | SEQ ID NO: 870 | W G T T W R W Y P C W M A Q L G E L C D L E |
| (BL6) | SEQ ID NO: 869 | F Y P C W T A L L G E L C D L E P G P P A M |
| (BL7) | SEQ ID NO: 856 | W R R W Y P C W V A Q V G E L C D L E I E A |
| (BL8) | SEQ ID NO: 858 | R Q R W Y P C W M A R L G E L C D L D E P T |
| (BL9) | SEQ ID NO: 864 | D V L G D R W Y P C W I A K L G E L C D L D |
| (BL10) | SEQ ID NO: 901 | W Y P C W M A Q L G D L C D L E K P V T E R |
| (BL11) | SEQ ID NO: 874 | W Y P C W I A Q L G E L C D L D |
| (BL12) | SEQ ID NO: 875 | W Y P C W L A K L G E L C D L D |

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 612, 664, 671, 865, 856, 858, 864, 869, 870, 874, 875, and 901.

An IL-2Rβ ligand provided by the present disclosure can comprise a truncated amino acid sequence of any one of SEQ ID NOS: 612, 664, 671, 865, 856, 858, 864, 869, 870, 874, 875, and 901.

An IL-2Rβ ligand provided by the present disclosure can comprise an amino acid sequence selected from any one of SEQ ID NOS: 612, 664, 671, 865, 856, 858, 864, 869, 870, 874, 875, and 901, or a truncated amino acid sequence of any one of SEQ ID NOS: 612, 664, 671, 865, 856, 858, 864, 869, 870, 874, 875, and 901, wherein the amino acid sequence can independently comprise from 1 to 4 glycines (G) (SEQ ID NO: 9429) on the N-terminus, on the C-terminus, or on both the N- and C-termini.

An IL-2Rβ ligand provided by the present disclosure can comprise an amino acid sequence selected from any one of SEQ ID NOS: 612, 664, 671, 865, 856, 858, 864, 869, 870, 874, 875, and 901, or a truncated amino acid sequence of any one of SEQ ID NOS: 612, 664, 671, 865, 856, 858, 864, 869, 870, 874, 875, and 901, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 612, 664, 671, 865, 856, 858, 864, 869, 870, 874, 875, and 901 or to a truncated amino acid sequence of any one of SEQ ID NOS: 612, 664, 671, 865, 856, 858, 864, 869, 870, 874, 875, and 901.

An IL-2Rβ ligand of any one of SEQ ID NOS: 612, 664, 671, 865, 856, 858, 864, 869, 870, 874, 875, and 901 can bind to the hIL-2Rβ subunit with an $IC_{50}$ of less than 10 μM as determined using phage ELISA competition assays.

An IL-2Rβ ligand of any one of SEQ ID NOS: 612, 664, 671, 865, 856, 858, 864, 869, 870, 874, 875, and 901, a truncated IL-2Rβ ligand of any one of SEQ ID NOS: 612, 664, 671, 865, 856, 858, 864, 869, 870, 874, 875, and 901, or a substituted IL-2Rβ ligand of any one of SEQ ID NOS: 612, 664, 671, 865, 856, 858, 864, 869, 870, 874, 875, and 901 can bind to the hIL-2Rβ subunit with an $IC_{50}$ of less than 100 µM or less than 10 µM as determined using phage ELISA competition assays.

Certain IL-2Rβ ligands provided by the present disclosure can bind to a specific binding site on the hIL-2Rβ subunit that is different than the hIL-2Rβ binding site on the hIL-2Rβ subunit to which IL-2 binds.

These IL-2Rβ ligands do not compete for binding to the specific IL-2 binding site with IL-2, have no detectable binding to the hIL-2Rγc subunit, and bind to the hIL-2Rβ subunit with an $IC_{50}$ of less than 10 μM.

The specific binding site on the hIL-2Rβ subunit can be characterized by at least the following properties: (1) a group of IL-2Rβ ligands bind to a specific binding site on the IL-2Rβ subunit with an $IC_{50}$ of less than 10 μM; (2) each IL-2Rβ ligands within the group competitively binds to the specific binding site on the IL-2Rβ subunit with each of the other IL-2Rβ ligands within the group; (3) a peptide having the amino acid sequence of SEQ ID NO: 1044 does not compete for binding to a specific binding site on the IL-2Rβ subunit with the peptides within the group of IL-2R ligands; and (4) IL-2Rβ ligands having SEQ ID NOS: 58, 169, and 1042 do not bind competitively with IL-2 binding to IL-2Rβ, indicating that this IL-2Rβ ligand binding site is distinct from that of IL-2.

The group of IL-2Rβ ligands comprises at least the IL-2Rβ ligands having the amino acid sequence of any one of SEQ ID NOS: 58, 83, 142, 169, 170, and 663.

An IL-2Rγc ligand having the amino acid sequence of SEQ ID NO: 224 does not compete for binding to the specific binding site with the group of IL-2Rβ ligands.

This specific binding site on the IL-2Rβ subunit to which the group of IL-2Rβ ligands bind can be characterized using competitive binding assays as described, for example, in Example 27 and 28.

An IL-2Rβ ligand provided by the present disclosure can be a pH-biased IL-2Rβ ligand.

pH-Biased IL-2Rβ ligands can bind to the IL-2Rβ subunit with an $IC_{50}$ at pH 6 that is at least 10% less than the $IC_{50}$ for binding to the IL-2Rβ subunit at pH 7.5.

For example, the $IC_{50}$ for binding of a human IL-2Rβ ligand at pH 6.0 can be 0.5 μM, and the $IC_{50}$ for binding of the same IL-2Rβ ligand at pH 7.5 can be 1 μM. A pH-biased IL-2Rβ ligand can bind to the IL-2Rβ subunit at pH 6.0 with an $IC_{50}$ that is at least 10% less than the $IC_{50}$ for binding to the human IL-2Rβ subunit at pH 7.5, at least 25% less, at least 50% less, at least 100% less, or at least 200% less than the $IC_{50}$ for binding to the human IL-2Rβ subunit at pH 7.5.

A pH-biased binding affinity ($IC_{50}$) can be determined as described in Examples 24-27.

A pH-biased IL-2Rβ ligand can comprise, for example, from 5 to 30 amino acids.

A pH-biased IL-2Rβ ligand can bind to the human IL-2Rβ subunit at pH 6.0, for example, with an $IC_{50}$ from 1 μM to 100 μM and can bind to the human IL-2R subunit with an $IC_{50}$ greater than 100 μM at pH 7.5.

A pH-biased IL-2Rβ ligand can bind to the human IL-2Rβ subunit at pH 6.0, for example, with an $IC_{50}$ from 0.1 μM to 50 μM and can bind to the human IL-2R subunit with an $IC_{50}$ greater than 100 μM at pH 7.5.

A pH-biased IL-2Rβ ligand can bind to the human IL-2Rβ subunit at pH 6.0, for example, with an $IC_{50}$ of less than 100 μM and can bind to the human IL-2R subunit, for example, with an $IC_{50}$ greater than 100 μM at pH 7.5.

A pH-biased IL-2Rβ ligand can bind to a mammalian IL-2Rβ subunit at pH 6.0, for example, with an $IC_{50}$ of less than 100 μM and can bind to the human IL-2R subunit with an $IC_{50}$ greater than 100 μM at pH 7.5.

pH-biased IL-2Rβ ligands can be identified using the methods described in Examples 23 and 24. These methods, based on acidic-biased affinity selection, have been used to identify IL-2Rβ ligands having increased binding affinity at a pH less than pH 6.5 commensurate with a solid tumor microenvironment and having decreased binding affinity at a pH greater than pH 7.0 commensurate with that of normal tissue.

An IL-2Rγc ligand can include an IL-2Rγc ligand disclosed in U.S. Application Publication No. 2020/0040036 A1, which is incorporated by reference in its entirety.

An IL-2Rγc ligand provided by the present disclosure can bind to the human IL-2Rγc subunit with an $IC_{50}$ of less than 100 μM, less than 10 μM, less than 1 μM, less than 0.1 μM, or less than 0.01 μM.

An IL-2Rγc ligand provided by the present disclosure can bind to the human IL-2Rγc subunit with an $IC_{50}$ from 1 μM to 100 μM, from 10 μM to 10 μM, from 100 μM to 1 μM, from, 0.001 μM to 1 μM, or from 0.01 μM to 1 μM.

An IL-2Rγc ligand provided by the present disclosure can bind to a mammalian IL-2Rγc subunit with an $IC_{50}$, for example, of less than 100 μM, less than 10 μM, less than 1 μM, less than 0.1 μM, or less than 0.01 μM.

An IL-2Rγc ligand provided by the present disclosure can bind to a mammalian IL-2Rγc subunit with an $IC_{50}$, for example, from 1 μM to 100 μM, from 10 μM to 10 μM, from 100 μM to 1 μM, from, 0.001 μM to 1 μM, or from 0.01 μM to 1 μM.

An IL-2Rγc ligand can comprise the amino acid sequence of Formula (5) (SEQ ID NO: 944), Formula (5a) (SEQ ID NO: 945), Formula (5b) (SEQ ID NO: 946), Formula (5c) (SEQ ID NO: 947), Formula (5d) (SEQ ID NO: 948), and/or Formula (5e) (SEQ ID NO: 949):

$$-X^{171}-X^{172}-X^{173}-X^{174}-X^{175}-C-X^{176}-X^{177}-X^{178}-X^{179}-X^{180}-X^{181}-X^{182}-X^{183}-C-X^{184}-X^{185}-X^{186}-X^{187}-X^{188}- \quad (5)$$

$$-X^{172}-X^{173}-X^{174}-X^{175}-C-X^{176}-X^{177}-X^{178}-X^{179}-X^{180}-X^{181}-X^{182}-X^{183}-C-X^{184}-X^{185}-X^{186}-X^{187}- \quad (5a)$$

$$-X^{173}-X^{174}-X^{175}-C-X^{176}-X^{177}-X^{178}-X^{179}-X^{180}-X^{181}-X^{182}-X^{183}-C-X^{184}-X^{185}-X^{186}- \quad (5b)$$

$$-X^{174}-X^{175}-C-X^{176}-X^{177}-X^{178}-X^{179}-X^{180}-X^{181}-X^{182}-X^{183}-C-X^{184}-X^{185}- \quad (5c)$$

$$-X^{175}-C-X^{176}-X^{177}-X^{178}-X^{179}-X^{180}-X^{181}-X^{182}-X^{183}-C-X^{184}- \quad (5d)$$

$$-C-X^{176}-X^{177}-X^{178}-X^{179}-X^{180}-X^{181}-X^{182}-X^{183}-C- \quad (5e)$$

wherein, $X^{171}$ can be selected from an amino acid comprising a basic side chain; $X^{172}$ can be selected from an amino acid comprising a hydroxyl-containing side chain; $X^{173}$ can be selected from an amino acid comprising an acidic side chain or a large hydrophobic side chain; $X^{174}$ can be selected from an amino acid comprising a large hydrophobic side chain; $X^{175}$ can be selected from an amino acid comprising an acidic side chain or a large hydrophobic side chain; $X^{176}$ can be selected from an amino acid comprising an acidic side chain or a polar/neutral side chain; $X^{177}$ can be selected from an amino acid comprising an acidic side chain; $X^{178}$ can be selected from an amino acid comprising a large hydrophobic side chain or an aromatic side chain; $X^{179}$ can be selected from an amino acid comprising an acidic side chain or a polar/neutral side chain; $X^{180}$ can be G; $X^{181}$ can be V; $X^{182}$ can be E; $X^{183}$ can be L; $X^{184}$ can be W; $X^{185}$ can be selected from an amino acid comprising a large hydrophobic side chain; $X^{186}$ can be E; $X^{187}$ can be selected from an amino acid; and $X^{188}$ can be selected from an amino acid comprising an acidic side chain.

In IL-2Rγc ligands of Formula (5), (5a), (5b), (5c), (5d), and/or (5e), $X^{171}$ can be selected from H, K, and R; $X^{172}$ can be selected from S, T, and Y; $X^{173}$ can be selected from D, E, F, I, L, M, V, W, and Y; $X^{174}$ can be selected from F, I, L, M, V, W, and Y; $X^{175}$ can be selected from D, E, F, I, L, M, V, W, and Y; $X^{176}$ can be selected from D, E, H, N, Q, S, T, and Y; $X^{177}$ can be selected from D and E; $X^{178}$ can be selected from F, H, I, L, M, V, W, and Y; $X^{179}$ can be selected from D, E, H, N, Q, S, T, and Y; $X^{180}$ can be G; $X^{181}$ can be V; $X^{182}$ can be E; $X^{183}$ can be L; $X^{184}$ can be W; $X^{185}$ can be selected from F, I, L, M, V, W, Y, H, N, Q, S, and T; $X^{186}$ can be E; $X^{187}$ can be selected from an amino acid; and $X^{188}$ can be selected from D and E.

In IL-2Rγc ligands of Formula (5), (5a), (5b), (5c), (5d), and/or (5e), $X^{171}$ can be selected from D, E, G, H, K, M, N, P, Q, R, S, and T; $X^{172}$ can be selected from A, D, E, G, I, K, L, P, Q, R, S, T, V, W, and Y; $X^{173}$ can be selected from A, D, E, F, G, I, Q, S, T, V, W, and Y; $X^{174}$ can be selected from A, I, E, I, L, M, N, Q, R, S, T, and V; $X^{175}$ can be selected from A, E, I, L, M, N, Q, R, S, T, and V; $X^{176}$ can be selected from D, E, H, L, Q, R, and V; $X^{177}$ can be selected from D, E, N, T, and V; $X^{178}$ can be selected from F, S, W, and Y; $X^{179}$ can be selected from A, D, E, G, H, K, N, Q, R, and Y; $X^{180}$ can be selected from G and R; $X^{181}$ can be V; $X^{182}$ can be selected from D, E, and Y; $X^{183}$ can be selected from F, I, and L; $X^{184}$ can be W; $X^{185}$ can be selected from C, H, I, L, P, Q, T, V, and Y; $X^{186}$ can be selected from A, D, E, G, M, R, S, T, and V; $X^{187}$ can be selected from A, D, E, F, G, I, M, N, P, Q, R, S, T, V, W, and Y; and $X^{188}$ can be selected from A, C, D, E, F, G, I, K, L, N, P, Q, R, S, and V.

In IL-2Rγc ligands of Formula (5), (5a), (5b), (5c), (5d), and/or (5e), $X^{171}$ can be selected from H, K, and R; $X^{172}$ can be selected from S, T, and Y; $X^{173}$ can be selected from D, E, F, I, and V; $X^{174}$ can be selected from I and V; $X^{175}$ can be selected from E, I, L, M, and V; $X^{176}$ can be selected from D, E, and Q; $X^{177}$ can be selected from D and E; $X^{178}$ can be selected from F and W; $X^{179}$ can be selected from D, E, N, and Q; $X^{180}$ can be G; $X^{181}$ can be V; $X^{182}$ can be selected from D and E; $X^{183}$ can be L; $X^{184}$ can be W; $X^{185}$ can be selected from I, L, Q, and V; $X^{186}$ can be selected from D and E; $X^{187}$ can be selected from A, D, E, F, G, I, M, N, P, Q, R, S, T, V, W, and Y; and $X^{188}$ can be selected from D, E, N, and Q.

In IL-2Rγc ligands of Formula (5), (5a), (5b), (5c), (5d), and/or (5e), $X^{171}$ can be selected from K and R; $X^{172}$ can be selected from S, T, and Y; $X^{173}$ can be selected from D, E, F, I, and V; $X^{174}$ can be V; $X^{175}$ can be selected from E, L, M, and V; $X^{176}$ can be Q; $X^{177}$ can be selected from D and E; $X^{178}$ can be W; $X^{179}$ can be selected from D, E, N, and Q; $X^{180}$ can be G; $X^{181}$ can be V; $X^{182}$ can be E; $X^{183}$ can be L; $X^{184}$ can be W; $X^{185}$ can be selected from I, L, Q, and V; $X^{186}$ can be selected from D and E; $X^{187}$ can be selected from A, D, E, F, G, I, M, N, P, Q, R, S, T, V, W, and Y; and $X^{188}$ can be selected from D, E, N, and Q.

In IL-2Rγc ligands of Formula (5), $X^{171}$ can be selected from H, K, and R.

In IL-2Rγc ligands of Formula (5)-(5a), $X^{172}$ can be selected from S, T, and Y.

In IL-2Rγc ligands of Formula (5)-(5b), $X^{173}$ can be selected from D, E, F, I, L, M, V, W, and Y.

In IL-2Rγc ligands of Formula (5)-(5b), $X^{173}$ can be selected from D and E.

In IL-2Rγc ligands of Formula (5)-(5b), $X^{173}$ can be selected from F, I, L, M, V, W, and Y.

In IL-2Rγc ligands of Formula (5)-(5c), $X^{174}$ can be selected from F, I, L, M, V, W, and Y.

In IL-2Rγc ligands of Formula (5)-(5c), $X^{174}$ can be V.

In IL-2Rγc ligands of Formula (5)-(5d), $X^{175}$ can be selected from D, E, F, I, L, M, V, W, and Y.

In IL-2Rγc ligands of Formula (5)-(5d), $X^{175}$ can be selected from D and E.

In IL-2Rγc ligands of Formula (5)-(5d), $X^{175}$ can be selected from F, I, L, M, V, W, and Y.

In IL-2Rγc ligands of Formula (5)-(5e), $X^{176}$ can be selected from D, E, H, N, Q, S, T, and Y.

In IL-2Rγc ligands of Formula (5)-(5e), $X^{176}$ can be selected from E and Q.

In IL-2Rγc ligands of Formula (5)-(5e), $X^{177}$ can be selected from D and E.

In IL-2Rγc ligands of Formula (5)-(5e), $X^{178}$ can be selected from F, H, I, L, M, V, W, and Y.

In IL-2Rγc ligands of Formula (5)-(5e), $X^{178}$ can be selected from F, H, W, and Y.

In IL-2Rγc ligands of Formula (5)-(5e), $X^{178}$ can be W.

In IL-2Rγc ligands of Formula (5)-(5e), $X^{179}$ can be selected from D, E, H, N, Q, S, T, and Y.

In IL-2Rγc ligands of Formula (5)-(5e), $X^{179}$ can be selected from D, E, and Q.

In IL-2Rγc ligands of Formula (5)-(5e), $X^{180}$ can be G.

In IL-2Rγc ligands of Formula (5)-(5e), $X^{181}$ can be V.

In IL-2Rγc ligands of Formula (5)-(5e), $X^{182}$ can be E.

In IL-2Rγc ligands of Formula (5)-(5e), $X^{183}$ can be L.

In IL-2Rγc ligands of Formula (5)-(5d), $X^{184}$ can be W.

In IL-2Rγc ligands of Formula (5)-(5c), $X^{185}$ can be selected from F, I, L, M, V, W, and Y.

In IL-2Rγc ligands of Formula (5)-(5c), $X^{185}$ can be L.

In IL-2Rγc ligands of Formula (5)-(5b), $X^{186}$ can be E.

In IL-2Rγc ligands of Formula (5)-(5a), $X^{187}$ can be selected from an amino acid.

In IL-2Rγc ligands of Formula (5), $X^{188}$ can be selected from D and E.

In IL-2Rγc ligands of Formula (5), (5a), (5b), (5c), (5d), and/or (5e), $X^{171}$ can be selected from H, K, and R; $X^{172}$ can be selected from S, T, and Y; $X^{173}$ can be selected from D, E, F, I, L, M, V, W, and Y; $X^{174}$ can be selected from F, I, L, M, V, W, and Y; $X^{175}$ can be selected from D, E, F, I, L, M, V, W, and Y; $X^{176}$ can be selected from D, E, H, N, Q, S, T, and Y; $X^{177}$ can be selected from D and E; $X^{178}$ can be selected from F, H, I, L, M, V, W, and Y; $X^{179}$ can be selected from D, E, H, N, Q, S, T, and Y; $X^{180}$ can be G; $X^{181}$ can be V; $X^{182}$ can be E; $X^{183}$ can be L; $X^{184}$ can be selected from W; $X^{185}$ can be selected from F, I, L, M, V, W, and Y; $X^{186}$ can be E; $X^{187}$ can be selected from an amino acid; and $X^{188}$ can be selected from D and E.

In IL-2Rγc ligands of Formula (5), (5a), (5b), (5c), (5d), and/or (5e), $X^{171}$ can be selected from H, K, and R; $X^{172}$ can be selected from S, T, and Y; $X^{173}$ can be selected from D and E; $X^{174}$ can be V; $X^{175}$ can be selected from D and E; $X^{176}$ can be selected from E and Q; $X^{177}$ can be selected from D and E; $X^{178}$ can be selected from F, H, W, and Y; $X^{179}$ can be selected from D, E, and Q; $X^{180}$ can be G; $X^{181}$ can be V; $X^{182}$ can be E; $X^{183}$ can be L; $X^{184}$ can be W; $X^{185}$ can be selected from F, I, L, M, V, W, Y, H, N, Q, S, and T; $X^{186}$ can be E; $X^{187}$ can be selected from an amino acid; and $X^{188}$ can be selected from D and E.

In IL-2Rγc ligands of Formula (5), (5a), (5b), (5c), (5d), and/or (5e), $X^{171}$ can be selected from H, K, and R; $X^{172}$ can be selected from S, T, and Y; $X^{173}$ can be selected from F, I, L, M, V, W, and Y; $X^{174}$ can be V; $X^{175}$ can be selected from F, I, L, M, V, W, and Y; $X^{176}$ can be selected from E and Q; $X^{177}$ can be selected from D and E; $X^{178}$ can be selected from F, H, W, and Y; $X^{179}$ can be selected from D, E, and Q; $X^{180}$ can be G; $X^{181}$ can be V; $X^{182}$ can be E; $X^{183}$ can be L; $X^{184}$ can be W; $X^{185}$ can be selected from F, I, L, M, V, W, Y, H, N, Q, S, and T; $X^{186}$ can be E; $X^{187}$ can be selected from an amino acid; and $X^{188}$ can be selected from D and E.

In IL-2Rγc ligands of Formula (5), (5a), (5b), (5c), (5d), and/or (5e), $X^{171}$ can be selected from H, K, and R; $X^{172}$ can be selected from S, T, and Y; $X^{173}$ can be selected from D, E, F, I, L, M, V, W, and Y; $X^{174}$ can be V; $X^{175}$ can be selected from D, E, F, I, L, M, V, W, and Y; $X^{176}$ can be selected from D, E, H, N, Q, S, T, and Y; $X^{176}$ can be selected from E and Q; $X^{177}$ can be selected from D and E; $X^{178}$ can be W; $X^{179}$ can be selected from D, E, and Q; $X^{180}$ can be G; $X^{181}$ can be V; $X^{182}$ can be E; $X^{183}$ can be L; $X^{184}$ can be W; $X^{185}$ can be selected from F, I, L, M, V, W, Y, H, N, Q, S, and T; $X^{186}$ can be E; $X^{187}$ can be selected from an amino acid; and $X^{188}$ can be selected from D and E.

An IL-2Rγc ligand can comprise an amino acid sequence selected from any one of SEQ ID NOS: 950-1028.

```
SEQ ID NO: 950    I E C D T S Y G V Y I C W Q
SEQ ID NO: 951    I E C E E W R G V E L C W Q
SEQ ID NO: 952    P E G R E V V V C R D W Y G V E L C W Q
SEQ ID NO: 953    I W G R T V V E C Q D W E G V E L C W Q
SEQ ID NO: 954    L A L R K E V V C Q E Y Y G V E L C W I
SEQ ID NO: 955    H E A R E V V V C Q D W Y G V E L C W Q
SEQ ID NO: 956    M V N R E V V V C E D W Y G V E L C W Q
SEQ ID NO: 957    T A N Q T V V E C Q V W G G V E L C W Q
SEQ ID NO: 958    V E C Q E W G G V E L C W C
SEQ ID NO: 959    D V E C V D W G G V E L C W H
SEQ ID NO: 960    I V C E E W R G V E L C W L
SEQ ID NO: 961    D F E R S Y V V C Q D W D G V E L C W I
SEQ ID NO: 962    A H S R Q E V V C E E W Y G V E L C W I
SEQ ID NO: 963    S A P E R W V E C E D W Q G V E L C W V
SEQ ID NO: 964    Y S R E L Y V Q C E D W E G V E L C W I
SEQ ID NO: 965    V V C Q D W E G V E L C W Q
SEQ ID NO: 966    D V V C Q N W E G V D L C W H
SEQ ID NO: 967    S A G R Q E V V C Q D W N G V E L C W I
SEQ ID NO: 968    G Q G R E V V V C H D W Y G V E L C W Q
SEQ ID NO: 969    D W R R S V V E C Q D W Y G V E L C W Q
SEQ ID NO: 970    D V V C Q N W D G V D L C W H
SEQ ID NO: 971    T L G R T V V E C Q D W G G V E L C W Q
SEQ ID NO: 972    R L L N S V V E C L D W E G V E L C W Q
SEQ ID NO: 973    I V C E D W R G V E L C W I
SEQ ID NO: 974    V V C Q E W E G V E L C W C
SEQ ID NO: 975    G D R P K E V V C E D W K G V E L C W I
SEQ ID NO: 976    E R P R S F I E C Q E W E G V E L C W L
SEQ ID NO: 977    E G S T T T I E C E E W A G V E L C W L
SEQ ID NO: 978    A N Q N T V V E C Q D W H G V E L C W Q
SEQ ID NO: 979    R S D D E V V V C Q E W E G V E L C W Q
SEQ ID NO: 980    I E C E E W A G V E L C W L
SEQ ID NO: 981    T W N M S E L E C Q D W N G V E I C W H
SEQ ID NO: 982    G N D D S Y I V C E E W K G V E L C W I
```

| | |
|---|---|
| SEQ ID NO: 983 | F A H H G V V E C Q E W Y G V E L C W Q |
| SEQ ID NO: 984 | L N R S V W I E C E E Y E G V E L C W L |
| SEQ ID NO: 985 | W S K K A E V V C E E W G G V E F C W I |
| SEQ ID NO: 986 | R S N Q T V V E C Q D W E G V E L C W Q |
| SEQ ID NO: 987 | V V C Q E W E G V E L C W Y A G E C M Q |
| SEQ ID NO: 988 | I L C Q E F E G V E L C W L E E S L A E |
| SEQ ID NO: 989 | K S Q V E C Q D W E G V E L C W V V S E |
| SEQ ID NO: 990 | K I T V E C Q D W D G V E L C W P T W I |
| SEQ ID NO: 991 | R P Q I E C Q E W Q G V E L C W T R E E |
| SEQ ID NO: 992 | V S C Q E W D G V E L C W V D G D L A A |
| SEQ ID NO: 993 | I M C Q E W D G V E L C W L E R D K A N |
| SEQ ID NO: 994 | G L E I A C E D W Y G V E L C W L R R A |
| SEQ ID NO: 995 | G Y G V L C Q E W Q G V E L C W P V Q R E A G V |
| SEQ ID NO: 996 | P Y G V V C Q D W A G V E L C W V E N R |
| SEQ ID NO: 997 | K L T V E C Q D W D G V E L C W V G V E |
| SEQ ID NO: 998 | I N C Q T W N G V E L C W V D E G L Y Q |
| SEQ ID NO: 999 | V V C Q E W E G V E L C W V E P P L L P |
| SEQ ID NO: 1000 | R V Q V E C E D W N G V E L C W P V R V |
| SEQ ID NO: 1001 | D R Q V V C E E W D G V E L C W I E E S |
| SEQ ID NO: 1002 | K T T V A C Q D W G G V E L C W V E R V |
| SEQ ID NO: 1003 | R P E V V C Q E W E G V E L C W I S P L |
| SEQ ID NO: 1004 | R L G V E C Q E W E G V D L C W I S A F |
| SEQ ID NO: 1005 | K P V V C E E W Q G V E L C W L E I Q |
| SEQ ID NO: 1006 | V V C E V F Q G V E L C W C E N E E F T |
| SEQ ID NO: 1007 | T D E V S C Q E W E G V E L C W I E R Q |
| SEQ ID NO: 1008 | P V E V R C Q E W E G V E L C W V V G I |
| SEQ ID NO: 1009 | G P E V V C E E F N R V E L C W V E Y N |
| SEQ ID NO: 1010 | K Y I V E C Q E W G G V E L C W P E M V |
| SEQ ID NO: 1011 | V T C Q E Y E G V E L C W T V G C A Y S |
| SEQ ID NO: 1012 | V V C Q E W E G V E L C W Q T G P G A H A |
| SEQ ID NO: 1013 | I V C E E Y N G V E L C W V E T S V K P |
| SEQ ID NO: 1014 | E Q Q V V C Q E W N G V E L C W I E A G |
| SEQ ID NO: 1015 | Q L G V E C Q N W R G V E L C W V S E I |
| SEQ ID NO: 1016 | T A E V V C Q E W D G V E L C W I E V L |
| SEQ ID NO: 1017 | S P S I V C E E W A G V E L C W V D Y S |
| SEQ ID NO: 1018 | A V C Q D W Y G V E L C W C M Q D I L D |
| SEQ ID NO: 1019 | V E C E E W G G V E L C W L A D E V M W |
| SEQ ID NO: 1020 | H S T V I C Q D W D G V E L C W I E N D |
| SEQ ID NO: 1021 | K K I V V C Q D W G G V E L C W T E D D |

-continued

| | |
|---|---|
| SEQ ID NO: 1022 | S V E V V C E E W H G V E L C W P V F I |
| SEQ ID NO: 1023 | R W A V S C Q D W Q G I E L C W P E W D |
| SEQ ID NO: 1024 | R T G V E C Q D W H G V E L C W P V W E |
| SEQ ID NO: 1025 | G Y G V V C E D F R G V E L C W L E R K |
| SEQ ID NO: 1026 | R T E V E C E D W E G V E L C W L |
| SEQ ID NO: 1027 | I L C E E W Q G V E L C W L E G G G S |
| SEQ ID NO: 1028 | V G I E C E E W A G V E L C W L |

An IL-2Rγc ligand can comprise an amino acid sequence selected from any one of SEQ ID NOS: 944-1028, wherein the amino acid sequence can be terminated with flanking amino acids such as -G-G- (SEQ ID NO: 9399) on the N-terminus, on the C-terminus, or on both the N- and C-termini.

An IL-2Rβγc ligand can comprise an amino acid sequence selected from any one of SEQ ID NOS: 944-1028, wherein the amino acid sequence can be terminated with one or more amino acids on the N-terminus, on the C-terminus, or on both the N- and C-termini. For example, an amino acid sequence can include terminal glycines and/or serines. For example, an IL-2Rγc ligand can comprise a -G-G- (SEQ ID NO: 9399) moiety on the N-terminus, on the C-terminus, or on both the N- and C-termini.

An IL-2Rγc ligand can comprise an amino acid sequence selected from any one of SEQ ID NOS: 944-1028, wherein each amino acid independently comprises one or more of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

IL-2Rγc ligands of SEQ ID NOS: 944-1028 bind to the human IL-2Rγc subunit with an $IC_{50}$ of less than 100 μM.

An IL-2Rγc ligand can comprise an amino acid sequence having an amino acid similarity greater than 60%, greater than 70%, greater than 75%, greater than 80%, greater than 85%, greater than 90%, or greater than 95% to the amino acid sequence of any one of SEQ ID NOS: 944-1028.

An IL-2Rγc ligand provided by the present disclosure can comprise a truncated amino acid sequence of any one of SEQ ID NOS: 944-1028.

An IL-2Rγc ligand provided by the present disclosure can comprise an amino acid sequence selected from any one of SEQ ID NOS: 944-1028, or a truncated amino acid sequence of any one of SEQ ID NOS: 944-1028, wherein the amino acid sequence can independently comprise from 1 to 4 glycines (G) (SEQ ID NO: 9429) on the N-terminus, on the C-terminus, or on both the N- and C-termini.

An IL-2Rγc ligand provided by the present disclosure can comprise an amino acid sequence selected from any one of SEQ ID NOS: 944-1028, or a truncated amino acid sequence of any one of SEQ ID NOS: 944-1028, wherein the amino acid sequence comprises one or more amino acid substitutions such as from 1 to 5 amino acid substitutions. The amino acid substitutions can comprise conservative amino acid substitutions.

An IL-2Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 944-1028 or to a truncated amino acid sequence of any one of SEQ ID NOS: 944-1028.

An IL-2Rγc ligand of any one of SEQ ID NOS: 944-1028 can bind to the hIL-2Rγc subunit with an $IC_{50}$ of less than 10 μM as determined using phage ELISA competition assays.

An IL-2Rγc ligand of any one of SEQ ID NOS: 944-1028, a truncated IL-2Rγc ligand of any one of SEQ ID NOS: 944-1028, or a substituted IL-2Rγc ligand of any one of SEQ ID NOS: 944-1028 can bind to the hIL-2Rγc subunit with an $IC_{50}$ of less than 100 μM or less than 10 μM as determined using phage ELISA competition assays.

An IL-2Rγc ligand can comprise an amino acid sequence selected from any one of IL-2Rγc ligands (GL1)-(GL7) having SEQ ID NOS: 965, 980, 981, 985, 1024, 1026, and 1028. The amino acid sequence of these IL-2Rγc ligands is shown in Table 2.

TABLE 2

| IL-2Rγc Ligands. | | | |
|---|---|---|---|
| (GL1) | SEQ ID NO: 980 | I E C E E W A G V E L C W L |
| (GL2) | SEQ ID NO: 965 | V V C Q D W E G V E L C W Q |
| (GL3) | SEQ ID NO: 985 | W S K K A E V V C E E W G G V E F C W I |
| (GL4) | SEQ ID NO: 1024 | R T G V E C Q D W H G V E L C W P V W E |

TABLE 2-continued

IL-2Rγc Ligands.

| | | |
|---|---|---|
| (GL5) | SEQ ID NO: 1028 | V G I E C E E W A G V E L C W L |
| (GL6) | SEQ ID NO: 981  | T W N M S E L E C Q D W N G V E I C W H |
| (GL7) | SEQ ID NO: 1026 | R T E V E C E D W E G V E L C W L |

An IL-2Rγc ligand can comprise an amino acid sequence having an amino acid sequence similarity greater than 60%, greater than 70%, greater than 75%, greater than 80%, greater than 85%, greater than 90%, or greater than 95%, to the amino acid sequence of any one of SEQ ID NOS: 965, 980, 981, 985, 1024, 1026, and 1028.

An IL-2Rγc ligand provided by the present disclosure can comprise a truncated amino acid sequence of any one of SEQ ID NOS: 965, 980, 981, 985, 1024, 1026, and 1028.

An IL-2Rγc ligand provided by the present disclosure can comprise an amino acid sequence selected from any one of SEQ ID NOS: 965, 980, 981, 985, 1024, 1026, and 1028, or a truncated amino acid sequence of any one of SEQ ID NOS: 965, 980, 981, 985, 1024, 1026, and 1028, wherein the amino acid sequence can independently comprise from 1 to 4 glycines (G) (SEQ ID NO: 9429) on the N-terminus, on the C-terminus, or on both the N- and C-termini.

An IL-2Rγc ligand provided by the present disclosure can comprise an amino acid sequence selected from any one of SEQ ID NOS: 965, 980, 981, 985, 1024, 1026, and 1028, or a truncated amino acid sequence of any one of SEQ ID NOS: 965, 980, 981, 985, 1024, 1026, and 1028, wherein the amino acid sequence comprises one or more amino acid substitutions such as from 1 to 5 amino acid substitutions. The amino acid substitutions can comprise conservative amino acid substitutions.

An IL-2Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 965, 980, 981, 985, 1024, 1026, and 1028 or to a truncated amino acid sequence of any one of SEQ ID NOS: 965, 980, 981, 985, 1024, 1026, and 1028.

An IL-2Rγc ligand of any one of SEQ ID NOS: 965, 980, 981, 985, 1024, 1026, and 1028 can bind to the hIL-2Rγc subunit with an $IC_{50}$ of less than 10 μM as determined using phage ELISA competition assays.

An IL-2Rγc ligand of anyone of SEQ ID NOS: 965, 980, 981, 985, 1024, 1026, and 1028, a truncated IL-2Rγc ligand of any one of SEQ ID NOS: 965, 980, 981, 985, 1024, 1026, and 1028, or a substituted IL-2Rγc ligand of any one of SEQ ID NOS: 965, 980, 981, 985, 1024, 1026, and 1028 can bind to the hIL-2Rγc subunit with an $IC_{50}$ of less than 100 μM or less than 10 μM as determined using phage ELISA competition assays.

An Rγc ligand can have any one of SEQ ID NOS: 1032, 1034, 1042, 1044, 1051-1060, and 1601-1613.

| | |
|---|---|
| SEQ ID NO: 1032 | S L L K C Y N A S T C A S V F |
| SEQ ID NO: 1034 | C G M A I G D L C M W T |
| SEQ ID NO: 1042 | R W G D V G D L L M P L |
| SEQ ID NO: 1044 | R S C Y Y K R P R L W C S E |
| SEQ ID NO: 1051 | D C S M W E G V E L C W G G R R |
| SEQ ID NO: 1052 | G G V V C Q D W E G V E L C W Q G G R R |
| SEQ ID NO: 1053 | G G V M C E R W Q G V E L C W L G G |
| SEQ ID NO: 1054 | G G R T G V E C Q D W H G V E L C W P V W E G G |
| SEQ ID NO: 1055 | G G V G I E C E E W A G V E L C W L G G |
| SEQ ID NO: 1056 | G G T W N M S E L E C Q D W N G V E I C W H G G |
| SEQ ID NO: 1057 | G G R T E V E C E D W E G V E L C W L G G |
| SEQ ID NO: 1058 | G G W S K K A E V V C E E W G G V E F C W I G G |
| SEQ ID NO: 1059 | W S K K A E V V C E E W G G V E F C W I |
| SEQ ID NO: 1060 | Y S R E L Y V Q C E D W E G V E L C W I |
| SEQ ID NO: 1601 | G G D C S M W E G V E L C W G G |
| SEQ ID NO: 1602 | G G V M C E R W Q G V E L C W L G G |
| SEQ ID NO: 1603 | G G V G I E C E E W A G V E L C W L G G |
| SEQ ID NO: 1604 | G G T W N M S E L E C Q D W N G V E I C W H G G |
| SEQ ID NO: 1605 | G G R T E V E C E D W E G V E L C W L G G |

-continued

SEQ ID NO: 1606  G G R T G V E C Q D W H G V E L C W P V W E G G

SEQ ID NO: 1607  G G V V C Q D W E G V Abu L C W Q G G

SEQ ID NO: 1608  G G V V C Q D W E G V Alb L C W Q G G

SEQ ID NO: 1609  G G V V C Q D W E G V DA L C W Q G G

SEQ ID NO: 1610  G G V V C Q D W E G V S L C W Q G G

SEQ ID NO: 1611  G G V V C Q D W E G V G L C W Q G G

SEQ ID NO: 1612  G G V V C Q D W E G V E L C W Q P P A

SEQ ID NO: 1613  G G V V C Q D W E G V E L C W Q G P P A

An Rγc ligand provided by the present disclosure can comprise a truncated amino acid sequence of any one of SEQ ID NOS: 1032, 1034, 1042, 1044, 1051-1060, and 1601-1613.

An Rγc ligand provided by the present disclosure can comprise an amino acid sequence selected from any one of SEQ ID NOS: 1032, 1034, 1042, 1044, 1051-1060, and 1601-1613, or a truncated amino acid sequence of any one of SEQ ID NOS: 1032, 1034, 1042, 1044, 1051-1060, and 1601-1613, wherein the amino acid sequence can independently comprise from 1 to 4 glycines (G) (SEQ ID NO: 9429) on the N-terminus, on the C-terminus, or on both the N- and C-termini.

An Rγc ligand provided by the present disclosure can comprise an amino acid sequence selected from any one of SEQ ID NOS: 1032, 1034, 1042, 1044, 1051-1060, and 1601-1613, or a truncated amino acid sequence of any one of SEQ ID NOS: 1032, 1034, 1042, 1044, 1051-1060, and 1601-1613, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1032, 1034, 1042, 1044, 1051-1060, and 1601-1613 or to a truncated amino acid sequence of any one of SEQ ID NOS: 1032, 1034, 1042, 1044, 1051-1060, and 1601-1613.

An Rγc ligand of any one of SEQ ID NOS: 1032, 1034, 1042, 1044, 1051-1060, and 1601-1613, a truncated Rγc ligand of any one of SEQ ID NOS: 1032, 1034, 1042, 1044, 1051-1060, and 1601-1613, or a substituted Rγc ligand of any one of SEQ ID NOS: 1032, 1034, 1042, 1044, 1051-1060, and 1601-1613 bind to the hRγc subunit with an $IC_{50}$ of less than 100 µM or less than 10 µM as determined using phage ELISA competition assays.

An Rγc ligand of any one of SEQ ID NOS: 1601-1613 binds to the hRγc subunit with an $IC_{50}$ of less than 100 µM.

Certain IL-2Rγc ligands provided by the present disclosure can bind to a specific binding site on the IL-2Rγc subunit that is different than the IL-2Rγc binding site on the IL-2Rγc subunit to which IL-2 binds.

These IL-2Rγc ligands do not compete for binding to the specific IL-2Rγc binding site with IL-2, have no detectable binding to the IL-2Rβ subunit, and bind to the IL-2Rγc subunit with an $IC_{50}$ of less than 10 µM.

The specific binding site on the IL-2Rγc subunit can be characterized by at least the following properties: (1) a group of IL-2Rγc ligands bind to the specific binding site on the hIL-2Rγc subunit with an $IC_{50}$ of less than 10 µM; (2) IL-2Rγc ligands within the group competitively bind to the specific binding site on the IL-2Rγc subunit with other IL-2Rγc ligands within the group; and (3) IL-2Rγc ligands within the group do not compete for binding to the specific binding site with an IL-2Rγc ligand having the amino acid sequence of SEQ ID NO: 1032.

An IL-2Rβ ligand having the amino acid sequence of SEQ ID NO: 58 does not compete for binding to the binding site with the group of IL-2Rγc ligands.

The group of IL-2Rγc ligands comprises IL-2Rγc ligands having an amino acid sequence of SEQ ID NOS: 198, 202, 224, 236, 248, and 266.

IL-2Rγc ligands within the group of IL-2Rγc ligands bind to the IL-2Rγc subunit with an $IC_{50}$ of less than 100 µM and bind to the IL-2Rβ subunit with an $IC_{50}$ of greater than 100 µM.

The specific binding site of the IL-2Rβ subunit for these IL-2Rγc ligands can be characterized using competitive binding assays as described, for example, in Examples 24-27.

An IL-2Rγc ligand provided by the present disclosure can comprise a pH-biased IL-2Rγc ligand.

pH-Biased IL-2Rγc ligands bind to the IL-2Rγc subunit at pH 6 with an $IC_{50}$ that is less than the $IC_{50}$ for binding of the same IL-2Rγc ligand to the IL-2Rγc subunit at pH 7.5. The pH-biased binding affinity can be determined as described in Examples 24-27.

A pH-biased IL-2Rγc ligand can bind to the human IL-2Rγc subunit at pH 6 with an $IC_{50}$ that is at least at least 10% less than the $IC_{50}$ for binding to the human IL-2Rγc subunit at pH 7.5, at least 25% less, at least 50% less, at least 100% less, or at least 200% less than the $IC_{50}$ for binding to the human IL-2Rγc subunit at pH 7.5.

A pH-biased IL-2Rγc ligand can comprise, for example, from 5 to 30 amino acids.

A pH-biased IL-2Rγc ligand can bind to the human IL-2Rγc subunit at pH 6.0 with an $IC_{50}$ from 1 µM to 100 µM and can bind to the human IL-2Rγc subunit with an $IC_{50}$ greater than 100 µM at pH 7.5.

A pH-biased IL-2Rγc ligand can bind to the human IL-2Rγc subunit at pH 6.0 with an $IC_{50}$ from 0.1 µM to 50 µM and bind to the human IL-2Rγc subunit with an $IC_{50}$ greater than 100 µM at pH 7.5.

A pH-biased IL-2Rγc ligand can bind to the human IL-2Rγc subunit at pH 6.0 with an $IC_{50}$ of less than 100 µM.

A pH-biased IL-2Rγc ligand can bind to each of the human IL-2Rγc subunit and to the human IL-2Rγc subunit with an $IC_{50}$ of less than 100 μM and a bind to the human IL-2Rγc subunit with an $IC_{50}$ greater than 100 μM at pH 7.5.

A pH-biased IL-2Rγc ligand can bind to a mammalian IL-2Rγc subunit at pH 6.0 with an $IC_{50}$ of less than 100 μM and bind to the human IL-2Rγc subunit with an $IC_{50}$ greater than 100 μM at pH 7.5.

pH-Biased IL-2Rγc ligands can be identified using the methods described in Examples 23 and 24.

An IL-2Rβ ligand, an IL-2Rγc ligand, and an IL-2Rβγc ligand may not comprise any flanking amino acids bound to the N-terminus and/or to the C-terminus of the ligand.

IL-2Rβ ligands and IL-2Rγc ligands can comprise one or more flanking amino acids bound to the N-terminus and/or to the C-terminus of the ligand.

The flanking amino acids can separate the portion of the ligand that interacts with IL-2R from other portions of a ligand, an IL-2Rβγc ligand, and/or a ligand construct.

A ligand can comprise flanking amino acids such as, for example, from 1 to 20 amino acids, from 1 to 10 amino acids, such as from 1 to 8 amino acids, from 2 to 6 amino acids, or from 2 to 4 amino acids bound to the N-terminus and/or the C-terminus of the ligand.

Flanking amino acids can comprise any suitable naturally occurring or non-naturally occurring amino acids.

Flanking amino acids can be selected from serine and flexible amino acids such as serine.

A ligand can comprise flanking amino acids such as, for example, terminal glycine groups on the N-terminus and/or the C-terminus of the respective ligand. For example, a ligand can comprise flanking amino acids having an amino acid sequence of any one of SEQ ID NOS: 9380-9407 and 9420-9428. For example, an IL-2Rβ ligand, an IL-2Rγc ligand, or an IL-2Rβγc ligand can independently comprise flanking amino acids such as 1, 2 or 3 terminal glycines.

An IL-2Rβ ligand, an IL-2Rγc ligand, and an IL-2Rβγc ligand can comprise, for example, from 1 to 20 amino acids, from 1 to 10 amino acids, such as from 1 to 8 amino acids, from 2 to 6 amino acids, or from 2 to 4 amino acids bound to the N-terminus and/or the C-terminus of the IL-2Rβ and IL-2Rγc ligand.

Flanking amino acids can comprise any suitable naturally occurring or non-naturally occurring amino acids.

Flanking amino acids can be selected from flexible amino acids such as glycine and serine. An IL-2Rβ ligand and/or an IL-2Rγc ligand can comprise, for example, terminal glycine groups on the N-terminus and/or the C-terminus of the respective ligand. For example, an IL-2Rβ and an IL-2Rγc ligand can comprise $(G)_n$ glycine groups (SEQ ID. NO: 9380) where n is from 1 to 20. For example, each of an IL-2Rβ ligand and an IL-2Rγc ligand can independently comprise 1, 2 or 3 terminal glycine groups. For example, a ligand having SEQ ID NO: 878, having the amino acid sequence -W-H-P-C-W-I-A-Q-L-G-E-L-C-D-L-E- can independently include, for example, one, two, or three glycines on both the N-terminus and the C-terminus such that the ligand can have the amino acid sequence -G-W-H-P-C-W-I-A-Q-L-G-E-L-C-D-L-E-G- (SEQ ID NO: 1209), -G-G-W-H-P-C-W-I-A-Q-L-G-E-L-C-D-L-E-G-G- (SEQ ID NO: 1210), or -G-G-G-W-H-P-C-W-I-A-Q-L-G-E-L-C-D-L-E-G-G-G- (SEQ ID NO: 1211), respectively.

An IL-2Rβ ligand, an IL-2Rγc ligand, and an IL-2Rβγc ligand provided by the present disclosure can comprise, for example, an amino acid substitution such as from 1 to 10 amino acid substitutions, from 1 to 8, from 1 to 6, from 1 to 4, such as 1, 2, 3, 4, 5, 6, 7, 8, 9, or 10 amino acid substitutions. An amino acid substitution can be a conservative amino acid substitution.

A ligand can comprise a truncated amino acid sequence.

A truncated amino acid sequence refers to an amino acid sequence which does not include one or more of the terminal amino acids. For example, in a truncated peptide one or more amino acids is removed from the N-terminus, the C-terminus or both the N-terminus and the C-terminus. Removing one or more amino acids from the N-terminus and/or the C-terminus of an amino acid sequence provided by the present disclosure can result in improved properties. Thus, ligands such as IL-2Rβ ligands and IL-2Rγc ligands provided by the present disclosure include truncated IL-2Rβ ligands and truncated Rγc ligands.

Examples of truncated IL-2Rβ ligands based on SEQ ID NO: 9301 include ligands having an amino acid sequence of any one of SEQ ID NOS: 9301-9314, 865, and 612.

| | |
|---|---|
| SEQ ID NO: 9301 | G G W Y P C W M A Q L G E L C D L D G G |
| SEQ ID NO: 9302 | G W Y P C W M A Q L G E L C D L D G G |
| SEQ ID NO: 9303 | W Y P C W M A Q L G E L C D L D G G |
| SEQ ID NO: 9304 | Y P C W M A Q L G E L C D L D G G |
| SEQ ID NO: 9305 | P C W M A Q L G E L C D L D G G |
| SEQ ID NO: 9306 | C W M A Q L G E L C D L D G G |
| SEQ ID NO: 9307 | G G W Y P C W M A Q L G E L C D L D G |
| SEQ ID NO: 9308 | G G W Y P C W M A Q L G E L C D L D |
| SEQ ID NO: 9309 | G G W Y P C W M A Q L G E L C D L |
| SEQ ID NO: 9310 | G G W Y P C W M A Q L G E L C D |
| SEQ ID NO: 9311 | G G W Y P C W M A Q L G E L C |
| SEQ ID NO: 9312 | G W Y P C W M A Q L G E L C D L D G |
| SEQ ID NO: 9313 | W Y P C W M A Q L G E L C D L D G |
| SEQ ID NO: 865 | W Y P C W M A Q L G E L C D L D |

-continued

| SEQ ID NO: 612 | Y P C W M A Q L G E L C D L |
| --- | --- |
| SEQ ID NO: 9314 | P C W M A Q L G E |

Examples of truncated IL-2Rγc ligands based on SEQ ID NO: 9340 include ligands having an amino acid sequence of any one of SEQ ID NOS: 9340-9353 and 965.

| SEQ ID NO: 9340 | G G V V C Q D W E G V E L C W Q G G |
| --- | --- |
| SEQ ID NO: 9341 | G V V C Q D W E G V E L C W Q G G |
| SEQ ID NO: 9342 | V V C Q D W E G V E L C W Q G G |
| SEQ ID NO: 9343 | V C Q D W E G V E L C W Q G G |
| SEQ ID NO: 9344 | C Q D W E G V E L C W Q G G |
| SEQ ID NO: 9345 | G G V V C Q D W E G V E L C W Q G |
| SEQ ID NO: 9346 | G G V V C Q D W E G V E L C W Q |
| SEQ ID NO: 9347 | G G V V C Q D W E G V E L C W |
| SEQ ID NO: 9348 | G G V V C Q D W E G V E L C |
| SEQ ID NO: 9349 | G V V C Q D W E G V E L C W Q G |
| SEQ ID NO: 965 | V V C Q D W E G V E L C W Q |
| SEQ ID NO: 9350 | V C Q D W E G V E L C W Q |
| SEQ ID NO: 9351 | V C Q D W E G V E L C W |
| SEQ ID NO: 9352 | C Q D W E G V E L c W |
| SEQ ID NO: 9353 | C Q D W E G V E L c |

An IL-2Rβ ligand provided by the present disclosure can have greater than 60%, greater than 70%, greater than 75%, greater than 80%, greater than 85%, greater than 90%, or greater than 95% sequence similarity to any one of SEQ ID NOS: 805-903. An IL-2Rβ ligand provided by the present disclosure can have greater than 60%, greater than 70%, greater than 75%, greater than 80%, greater than 85%, greater than 90%, or greater than 95% sequence similarity to SEQ ID NO: 865.

An IL-2Rγc ligand provided by the present disclosure can have greater than 60%, greater than 70%, greater than 75%, greater than 80%, greater than 85%, greater than 90%, or greater than 95% sequence similarity to any one of SEQ ID NOS: 944-1028. An IL-2Rγc ligand provided by the present disclosure can have greater than 60%, greater than 70%, greater than 75%, greater than 80%, greater than 85%, greater than 90%, or greater than 95% sequence similarity to SEQ ID NO: 965.

An IL-2Rβ ligand, an IL-2Rγc ligand, and an IL-2Rβγc ligand provided by the present disclosure can comprise an acetyl terminal group on the N-terminus and a carboxamide group on the C-terminus.

An IL-2Rβγc ligand can comprise an IL-2Rβ ligand and an IL-2Rγc ligand bound to an IL-2Rβγc ligand linker.

Each of an IL-2Rβ ligand and an IL-2Rγc ligand can independently be covalently bound to an IL-2Rβγc ligand linker through the N-terminus or the C-terminus of the respective ligand. For example, an IL-2Rβ ligand can be bound to the IL-2Rβγc ligand linker through the N-terminus and an IL-2Rγc ligand can be bound to an IL-2Rβγc ligand linker through the N-terminus; an IL-2Rβ ligand can be bound to an IL-2Rβγc ligand linker through the N-terminus and an IL-2Rγc ligand can be bound to the IL-2Rβγc ligand linker through the C-terminus; an IL-2Rβ ligand can be bound to the IL-2Rβγc ligand linker through the C-terminus and an IL-2Rγc ligand can be bound to the IL-2Rβγc ligand linker through the N-terminus; or an IL-2Rβ ligand can be bound to the IL-2Rβγc ligand linker through the C-terminus and an IL-2Rγc ligand can be bound to the IL-2Rβγc linker through the C-terminus.

Examples of IL-2Rβγc ligands having various orientations of the IL-2Rβ and IL-2Rγc ligands are shown in FIG. 1. As shown in FIG. 1, IL-2Rβγc ligands having various C/N orientations of the IL-2Rβ ligand and the IL-2Rγc ligand can be synthesized using click chemistry. The triazole linkage is a schematic representation of an IL-2Rγc ligand linker, which can comprise various chemical moieties and can have various lengths and properties. Examples of certain IL-2Rβγc ligand linkers are shown in Table 3.

An IL-2Rβγc ligand linker can be configured to facilitate binding of an IL-2Rβγc ligand to the IL-2Rβ subunit and to the IL-2Rγc subunit of IL-2R. For example, an IL-2Rβγc ligand linker can be configured to facilitate activation of IL-2R by the IL-2Rβγc ligand. For example, an IL-2Rβγc ligand can be configured to induce IL-2R-mediated STAT5 phosphorylation in TF-1β cells and in NK-92 cells.

An IL-2Rβγc ligand linker can have a length, for example, from 2 Å to 100 Å, from 2 Å to 80 Å, from 2 Å to 60 Å, from 2 Å to 40 Å, from 2 Å to 20 Å, from 4 Å to 18 Å, from 6 Å to 16 Å, or from 8 Å to 14 Å. A ligand linker can have a length, for example, less than 100 Å, less than 80 Å, less than 60 Å, less than 40 Å, less than 20 Å, less than 15 Å, or less than 10 Å.

An IL-2Rβγc ligand linker can comprise a backbone having, for example, from 2 to 50 bonds, from 2 to 45 bonds, from 2 to 40 bonds, from 2 to 35 bonds, from 2 to 30 bonds, from 2 to 25 bonds, from 2 to 20 bonds, from 4 to 18 bonds, from 6 to 16 bonds, or from 8 to 14 bonds. An IL-2Rβγc ligand linker can comprise a backbone having, for example, less than 50 bonds, less than 40 bonds, less than 30 bonds, less than 20 bonds, or less than 10 bonds.

An IL-2Rβγc ligand linker provided by the present disclosure can comprise a peptidyl IL-2Rβγc ligand or a chemical IL-2Rβγc linker.

An IL-2Rβγc ligand linker provided by the present disclosure can comprise a peptidyl IL-2Rβγc ligand linker.

A peptidyl ligand linker can comprise, for example, from 2 to 100 amino acids, from 2 to 80 amino acids, from 2 to 60 amino acids, from 2 to 40 amino acids, from 2 to 20 amino acids, from 5 to 10 amino acids, or from 2 to 5 amino acids. A peptidyl ligand linker can comprise, for example, less than 100 amino acids, less than 80 amino acids, less than 40 amino acids, less than 20 amino acids, less than 15 amino acids, less than 10 amino acids, or less than 5 amino acids. Amino acids forming a peptidyl IL-2Rβγc ligand linker can comprise naturally occurring amino acids and/or non-naturally occurring amino acids.

A peptidyl IL-2Rβγc ligand linker can comprise, for example, flexible amino acids such as glycine, serine, and/or threonine. Flexible linkers can include small, non-polar amino acids such as glycine or polar amino acids such as serine or threonine. The small size of these amino acids provides flexibility and allows for mobility of the connecting functional domains. Incorporation of serine or threonine can maintain the stability of the linker in aqueous solutions by forming hydrogen bonds with water molecules, and thereby reduces unfavorable interactions between the linker and protein moieties. Amino acids such as lysine and glutamic acid can be included to improve solubility. The length of a peptidyl IL-2Rβγc linker can be selected to provide a suitable separation between the IL-2Rβ and IL-2Rγc ligands to favor a desired interaction with IL-2R such as enhancing agonist activity. Examples of flexible linkers include peptides having an amino acid sequence of any one of SEQ ID NOS: 9380-9407.

A peptidyl IL-2Rβγc ligand linker can be a rigid linker. Rigid linkers can be proline rich and can include other amino acids such as alanine, lysine, and/or glutamic acid. Examples of rigid peptidyl ligand linkers include peptides having an amino acid sequence of any one of SEQ ID NOS: 9420-9428.

IL-2Rβγc ligands comprising a peptidyl IL-2Rβγc ligand linker can be synthesized using non-recombinant methods such as using the solid phase synthesis as described in Example 1 or can be synthesized using recombinant DNA technology.

An IL-2Rβγc ligand linker can comprise a synthetic chemical IL-2Rβγc ligand linker. A synthetic chemical IL-2Rβγc ligand linker refers to a linker that is synthesized using chemical methods and can include amino acids or may not include amino acids. A synthetic chemical IL-2Rβγc ligand linker can comprise a triazole moiety.

A synthetic chemical ligand linker can have the structure, for example, of Formula (L2)-(L13) as shown in Table 3.

TABLE 3

Examples of IL-2Rβγc synthetic chemical linkers.

| Formula No. | Chemical Structure |
|---|---|
| (L1) | 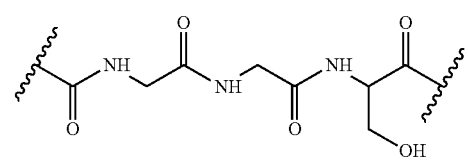 [SMILES: *C(=O)NCC(=O)NCC(=O)NC(CO)C(*)=O]  |
| (L2) | 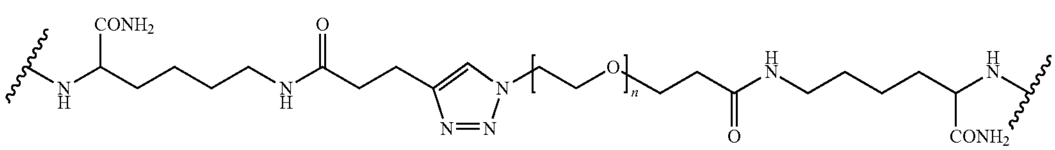  n = 2 |
| (L3) | 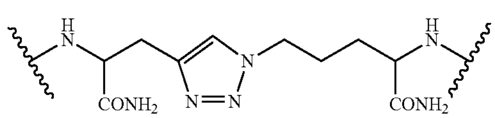 [SMILES: *NC(CCCn1cc(CC(N*)C(N)=O)nn1)C(N)=O]  |
| (L4) | 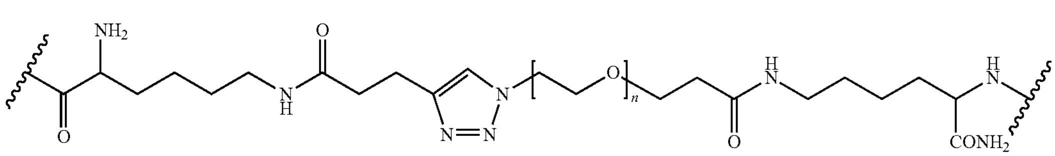  n = 2 |

TABLE 3-continued
Examples of IL-2Rβγc synthetic chemical linkers.
| Formula No. | Chemical Structure |
|---|---|
| (L5) | 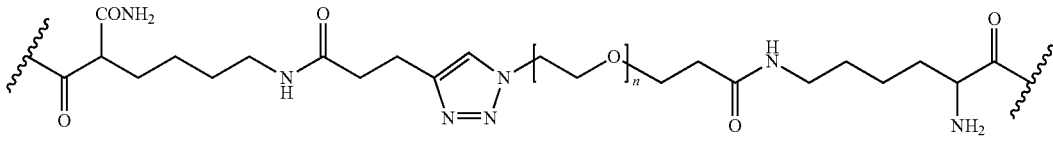 n = 2 |
| (L6) | 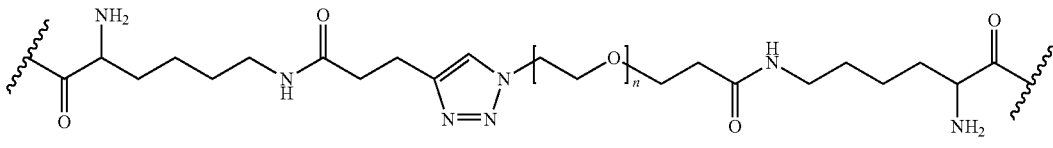 n = 2 |
| (L7) | 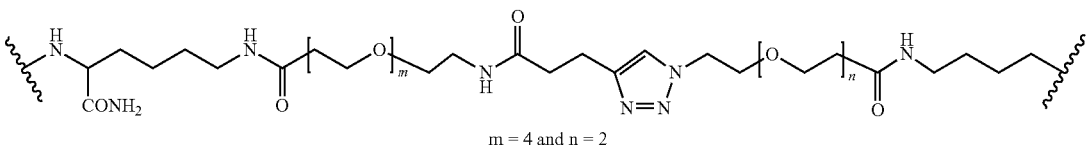 m = 4 and n = 2 |
| (L8) | 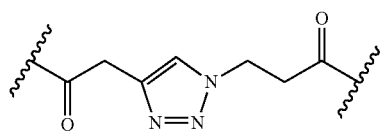 [SMILES: *C(=O)CCn1cc(CC(*)=O)nn1] |
| (L9) | 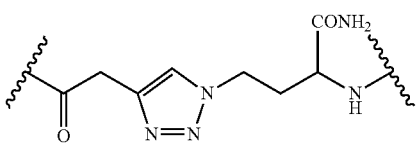 [SMILES: *NC(CCn1cc(CC(*)=O)nn1)C(N)=O] |
| (L10) | 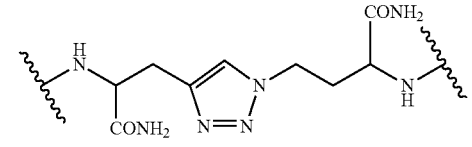 [SMILES: *NC(CCn1cc(CC(N*)C(N)=O)nn1)C(N)=O] |
| (L11) | 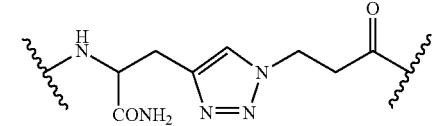 [SMILES: *NC(Cc1cn(CCC(*)=O)nn1)C(N)=O] |
| (L12) | 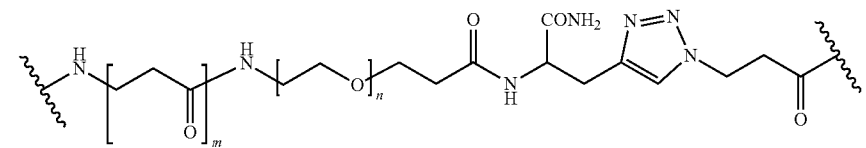 m = 2, n = 1 |
| (L13) | 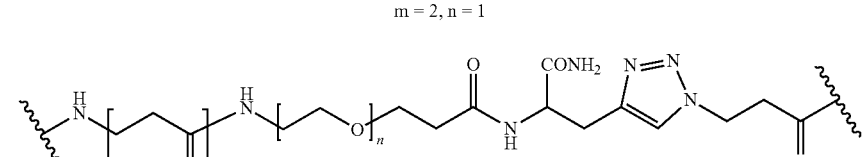 m = 2, n = 4 |

TABLE 3-continued

Examples of IL-2Rβγc synthetic chemical linkers.

| Formula No. | Chemical Structure |
|---|---|
| (L14) | [structure: CONH₂-bearing carbon linked via NH to one wavy bond and via propyl chain to triazole, then CH₂-C(=O)- to other wavy bond] |
| (L15) | [structure: CONH₂-bearing carbon linked via NH to wavy bond and via propyl chain to triazole, then CH₂-CH(CONH₂)-NH-wavy bond] |
| (L16) | [structure: wavy-C(=O)-CH₂CH₂-N(triazole)-CH₂-C(=O)-wavy] |
| (L17) | [structure: wavy-C(=O)-CH₂CH₂-N(triazole)-CH₂-CH(CONH₂)-NH-wavy] |

In IL-2Rγc ligand linkers (L2), (L4)-(L7), (L12) and L13), m and/or n can be an integer, for example, from 1 to 10.

A chemical IL-2Rβγc ligand linker can be synthesized using click chemistry to provide IL-2Rβγc ligands having various C/N orientations of the IL-2Rβ and IL-2Rγc ligands. C/N orientation refers to the terminus of the IL-2Rβ and IL-2Rγc which are bonded to the IL-2Rβγc ligand linker. For example, for an IL-2Rβγc ligand having a C/N orientation, the C-terminus of the IL-2Rβ ligand is bonded to the IL-2Rβγc ligand linker, and the N-terminus of the IL-2Rγc ligand is bonded to the IL-2Rβγc ligand linker. As another example, for an IL-2Rβγc ligand having an N/C orientation, the N-terminus of the IL-2Rβ ligand is bonded to the IL-2Rβγc ligand linker, and the C-terminus of the IL-2Rγc ligand is bonded to the IL-2Rβγc ligand linker.

An example of a method for preparing an IL-2Rβγc ligand having a synthetic ligand linker is described in Example 2.

IL-2Rβ and IL-2Rγc ligands can be prepared using standard solid phase peptide synthesis and Fmoc-protected amino acids. A swollen resin can be treated with either an activated solution of Fmoc-propargyl glycine or 2-(Fmoc-NH)-azido-pentanoic acid to provide the corresponding Fmoc-protected resin. The alkyne-containing moiety and the azide-containing moiety can be configured to have, for example, a desired length, rigidity/flexibility, polarity, lipophilicity, and/or steric property. The protected resin can be subjected to repeated cycles of Fmoc-amino acid couplings with HATU activation and Fmoc removal to synthesize the respective IL-2Rβ ligand or IL-2Rγc ligand. After Fmoc removal from the final amino acid of the IL-2Rβ or IL-2Rγc ligand and acylation of terminal amine groups, the ligands can be cleaved from the resin and purified.

The alkyne-containing moiety and azide-containing moiety can be reacted, for example, in the presence of CuSO₄ and a metal chelator to provide an IL-2Rβγc ligand comprising a synthetic chemical IL-2Rβγc ligand linker. The reacted alkyne-containing moiety and azide-containing moiety form the chemical ligand linker. For example, referring to Tables 3-5, an alkyne-containing moiety of Formula (AL) in Table 4 can be reacted with an azide-containing moiety of Formula (AZ) in Table 5 to provide a chemical IL-2Rβγc ligand linker of Formula (L) in Table 3.

Using this click-chemistry method, IL-2Rβγc ligands comprising IL-2Rβ and IL-2Rγc ligands having differing N-terminal and C-terminal orientations and different ligand linker lengths can be synthesized.

Examples of alkyne-containing moieties are provided in Table 4 and examples of azide-containing moieties are provided in Table 5.

TABLE 4

Examples of alkyne-containing moieties.

| Formula No. | Chemical Structure |
|---|---|
| (AL1) | [structure: wavy-NH-CH(CONH₂)-(CH₂)₃-NH-C(=O)-CH₂-C≡CH] |

TABLE 4-continued

Examples of alkyne-containing moieties.

| Formula No. | Chemical Structure |
|---|---|
| (AL2) | [structure: NH-CH(CONH₂)-C≡CH] |
| (AL3) | [structure: lysine derivative with NH-C(=O)-CH₂-C≡CH] |
| (AL4) | [structure: C(=O)-C≡CH] |
| (AL5) | [structure with n = 4] |
| (AL6) | [structure with m = 2 and n = 1] |
| (AL7) | [structure with m = 2 and n = 4] |
| (AL8) | [structure with m = 1 to 10, and n = 1 and 10] |
| (AL9) | [structure with m = 1 to 10, and n = 1 to 10] |

TABLE 5

Examples of azide-containing moieties.

| Formula No. | Chemical Structure |
|---|---|
| (AZ1) | ![structure with CONH2, NH, (O)n, N3; n = 2] |
| (AZ2) | ![structure with CONH2, N3] |
| (AZ3) | ![structure with NH2, NH, (O)n, N3; n = 2] |
| (AZ4) | ![structure with ketone, N3] |
| (AZ5) | ![structure with CONH2, N3] |

An IL-2Rβγc ligand can comprise N- and/or C-terminal modifications to prevent or minimize degradation by aminopeptidases and carboxypeptidases. Examples of terminal groups include an acetyl group on the N-terminus and a carboxamide group on the C-terminus.

IL-2Rβγc ligands provided by the present disclosure can comprise, for example, a moiety having the structure of Formula (6):

-BL-L-GL-             (6)

where BL comprises an IL-2Rβ ligand, L comprises an IL-2Rβγc ligand linker, and GL comprises an IL-2Rγc ligand.

A moiety of Formula (6) can be terminated in small chemical moieties and can have a molecular weight, for example, less than 12,000 Da, less than 11,000 Da, less than 10,000 Da, less than 9,000 Da, less than 8,000 Da, less than 7,000 Da, or less than 6,000 Da. An IL-2Rβγc ligand can have a molecular weight, for example, from 6,000 Da to 12,000 Da, from 7,000 Da to 11,000 Da, or from 8,000 Da to 10,000 Da.

In IL-2Rβγc ligands of Formula (6), BL can comprise an IL-2Rβ ligand having an amino acid sequence of any one of SEQ ID NOS: 805-903, or having an amino acid sequence having greater than 60%, greater than 70%, greater than 80%, greater than 85%, greater than 90%, or greater than 95% sequence similarity to any one SEQ ID NOS: 805-903; GL can comprise an IL-2Rγc ligand having an amino acid sequence of SEQ ID NOS: 944-1028, or having an amino acid sequence having greater than 60%, greater than 70%, greater than 80%, greater than 85%, greater than 90%, or greater than 95% sequence similarity to any one of SEQ ID NOS: 944-1028; and L can comprise a peptidyl IL-2Rβγc ligand linker or a chemical IL-2Rβγc ligand linker. Examples of suitable peptidyl IL-2Rβγc ligand linkers are disclosed in FIGS. 21A-21C, and examples of suitable chemical ligand linkers are disclosed in Table 3.

In IL-2Rβγc ligands of Formula (6), either the N-terminus or the C-terminus of the IL-2Rβ ligand can be bound to the IL-2Rβγc ligand linker and either the N-terminus or the C-terminus of IL-2Rγc ligand can be bound to the IL-2Rβγc ligand linker. For example, the C-terminus of the IL-2Rβ ligand (BL) can be bound to the linker (L) and the N-terminus of the IL-2Rγc ligand (GL) can be bound to the linker (L).

In IL-2Rβγc ligands of Formula (6) each of the IL-2Rβ ligand and the IL-2Rγc ligand can independently comprise one or more flanking amino acids bound to the N-terminus and/or the C-terminus of the ligand. For example, both the N-terminus and the C-terminus of the IL-2Rβ ligand can comprise $(G)_n$ (SEQ ID NO: 9380) and both the N-terminus and the C-terminus of the IL-2Rγc ligand can comprise— $(G)_n$ (SEQ ID NO: 9380). The flanking amino acids can be bound to the IL-2Rβγc ligand linker.

IL-2Rβγc ligands of Formula (6) can comprise an acetyl terminal group on the N-terminus and a carboxamide group on the C-terminus.

An IL-2Rβγc ligand provided by the present disclosure can comprise the structure of Formula (6a):

-(A)$_n$-BL-(A)$_n$-L-(A)$_n$-GL-(A)$_n$-             (6a)

where,
each n is independently an integer from 0 to 10;
BL is an IL-2Rβ ligand comprising:
   an amino acid sequence selected from any one of SEQ ID NOS: 805-903;

an amino acid sequence having greater than 60%, greater than 70%, greater than 80%, greater than 85%, or greater than 90% sequence identity to any one of SEQ ID NOS: 805-903;
a truncated amino acid sequence of any one of SEQ ID NOS: 805-903; or
a combination of any of the foregoing;
GL is an IL-2Rγc ligand comprising:
an amino acid sequence selected from any one of SEQ ID NOS: 944-1028;
an amino acid sequence having greater than 60%, greater than 70%, greater than 80%, greater than 85%, or greater than 90% sequence identity to any one of SEQ ID NOS: 944-1028;
a truncated amino acid sequence of any one of SEQ ID NOS: 944-1028; or
a combination of any of the foregoing;
each A is independently selected from an amino acid; and
L is a peptidyl ligand linker comprising from 1 to 50 amino acids.

In IL-2Rβγc ligands of Formula (6a), the C-terminus of the IL-2Rβ ligand can be bound to the peptidyl ligand linker, and the N-terminus of the IL-2Rγc ligand can be bound to the peptidyl ligand linker.

In IL-2Rβγc ligands of Formula (6a) each n can independently be selected from, for example, an integer from 0 to 8, from 0 to 6, from 0 to 4, or from 0 to 2. For example, n can be 0, 1, 2, or 3. (A) represents flanking amino acids.

Each A can independently be selected from a naturally occurring or non-naturally occurring amino acid. Each A can be independently selected from a flexible amino acid such as glycine and serine. Each A can be glycine.

L can comprise, for example, from 1 to 40 amino acids, from 1 to 30 amino acids, from 1 to 20 amino acids, from 1 to 10 amino acids, or from 1 to 5 amino acids. $L_a$ can be selected from a peptidyl ligand linker. For example, L can be a peptidyl ligand linker having an amino acid sequence of any one of SEQ ID NOS: 9380-9407 and 9420-9428.

Examples of IL-2Rβγc ligands having a chemical IL-2Rβγc ligand linker are listed in FIGS. 19A-19C.

Examples of IL-2Rβγc ligands having a peptidyl IL-2Rβγc ligand linker are listed in FIGS. 21A-21C.

IL-2Rβγc ligands provided by the present disclosure can comprise disulfide bonds. IL-2Rβ ligands and IL-2Rγc ligands can comprise at least two cysteines. The at least two cysteines of an IL-2Rβ ligand can be bound through disulfide bonds and each of the at least two cysteines of an IL-2Rγc ligand can be bound through a disulfide bond.

In an IL-2Rβγc ligand, two cysteines of the IL-2Rβ ligand can be bound together through a disulfide bond and/or two cysteines of the IL-2Rγc ligand can be bound together through a disulfide bond. In an IL-2Rβγc ligand a cysteine of an IL-2Rβ ligand can be bound to a cysteine of the IL-2Rγc ligand through a disulfide bond, or each of the two cysteines of an IL-2Rβ ligand can be bound to a cysteine of the IL-2Rγc ligand. For example, in an IL-2Rβγc ligand having the structure of Formula (7):

$$-X-C^1-X-C^2-X-L-Y-C^3-Y-C^4-Y- \quad (7)$$

where -X-$C^1$-X-$C^2$-X-represents an amino acid sequence of an IL-2Rβ ligand having two cysteines such as any one of SEQ ID NOS: 805-903, and where each X is independently one or more amino acids, —Y-$C^3$-Y-$C^4$-Y- represents an amino acid sequence of an IL-2Rγc ligand having two cysteines such as any one of SEQ ID NOS: 944-1028 and where each Y is independently one or more amino acids, and -L- is an IL-2Rβγc ligand linker coupling the IL-2Rβ ligand and the IL-2Rγc ligand.

In an IL-2Rβγc ligand of Formula (7), $C^1$ can be bound to $C^2$ and $C^3$ can be bound to $C^4$ through disulfide bonds; $C^1$ can be bound to $C^3$ and $C^2$ can be bound to $C^4$ through disulfide bonds, or $C^1$ can be bound to $C^4$ and $C^2$ can be bound to $C^3$ through disulfide bonds.

An IL-2Rβγc ligand can comprise an IL-2Rβ ligand provided by the present disclosure such as an amino acid sequence selected from any one of SEQ ID NOS: 805-903, 911-930, 2575-2655, 2661-2891, 2900-2926, and 2929-2939, a substituted amino acid sequence of an IL-2Rβ ligand of an IL-2Rβ ligand provided by the present disclosure, an amino acid sequence of an IL-2Rβ ligand provided by the present disclosure having from 1 to 5 flanking glycines (SEQ ID NO: 9430) on the N-terminus and/or the C-terminus, an amino acid sequence having greater than 60% sequence similarity to an IL-2Rβ ligand provided by the present disclosure, or a combination of any of the foregoing; and a Rγc ligand provided by the present disclosure such as an amino acid sequence selected from any one of SEQ ID NOS: 944-1028, 1032-1060, and 1601-1613, a substituted amino acid sequence of an IL-2Rγc ligand provided by the present disclosure, a truncated amino acid sequence of an IL-2Rγc ligand provided by the present disclosure, an amino acid sequence an IL-2Rγc ligand provided by the present disclosure having from 1 to 5 flanking glycines (SEQ ID NO: 9430) on the N-terminus and/or the C-terminus, an amino acid sequence having greater than 60% sequence similarity to an IL-2Rγc ligand provided by the present disclosure, or a combination of any of the foregoing.

An IL-2Rβγc ligand provided by the present disclosure can comprise an IL-2Rβ ligand having an amino acid sequence of any one of SEQ ID Nos: 865 and 9301-9314, or an amino acid sequence having greater than 60%, greater than 70%, greater than 75%, greater than 80%, greater than 85%, greater than 90%, or greater than 95% sequence similarity to any one of SEQ ID Nos: 865 and 9301-9314; and an IL-2Rγc ligand having an amino acid sequence of any one of SEQ ID NOS: 965 and 9340-9353, or an amino acid sequence having greater than 60%, greater than 70%, greater than 75%, greater than 80%, greater than 85%, greater than 90%, or greater than 95% sequence similarity to any one of SEQ ID Nos: 865 and 9301-9314.

IL-2Rβγc ligands provided by the present disclosure can comprise an IL-2Rβ ligand having SEQ ID NO: 865 or an amino acid sequence having greater than 60%, greater than 70%, greater than 75%, greater than 80%, greater than 85%, greater than 90%, or greater than 95 sequence similarity to SEQ ID NO: 865; and an IL-2Rγc ligand having SEQ ID NO: 965 or an amino acid sequence having greater than 60%, greater than 70%, greater than 75%, greater than 80%, greater than 85%, greater than 90%, or greater than 95% sequence similarity to SEQ ID NO: 965.

In IL-2Rβγc ligands the C-terminus of the IL-2Rβ ligand can be linked to the N-terminus of the IL-2Rγc ligand.

An IL-2Rβγc ligand can comprise an IL-2Rβ ligand having a truncated amino acid sequence of SEQ ID NO: 865 and an IL-2Rγc ligand having a truncated amino acid sequence SEQ ID NO: 965.

An IL-2Rβγc ligand can comprise an IL-2Rβ ligand having a substituted SEQ ID NO: 865 and an IL-2Rγc ligand having a substituted SEQ ID NO: 965, wherein the substitutions can comprise from 1 to 5 conservative amino acid substitutions or non-conservative amino acid substitutions, such as from 1 to 2 conservative amino acid substitutions or non-conservative amino acid substitutions.

Each of the IL-2Rβ ligand and the IL-2Rγc ligand can independently comprise one or more flanking amino acids such as one or more glycines. For example, each of the N-terminus and the C-terminus of the IL-2Rβ ligand and the IL-2Rγc ligand can independently comprise from 1 to 5 glycines (SEQ ID NO: 9430).

The N-terminus of the IL-2Rβ ligand can be coupled to the C-terminus of the IL-2Rγc ligand through a flexible linker comprising, for example, from 1 to 10 amino acids.

The linker can be, for example, a peptidyl linker having an amino acid sequence of any one of SEQ ID NOS: 9380-9407 and 9420-9428.

An IL-2Rβγc ligand can comprise the amino acid sequence of SEQ ID NO: 1263 (-GGWYPCW-MAQLGELCDLDGGGGSGGVVCQDWEGVELCWQGG-), or an amino acid sequence having greater than 60%, greater than 70%, greater than 75%, greater than 80%, greater than 85%, greater than 90%, or greater than 95% sequence similarity to SEQ ID NO: 1263.

An IL-2Rβγc ligand can comprise the amino acid sequence of SEQ ID NO: 1264 (-WYPCW-MAQLGELCDLDGGGGSGGVVCQDWEGVELCWQ-)

ligand can be bound together through disulfide bonds. In certain IL-2Rβγc ligands, the cysteines of the IL-2Rβ ligand can be bound to the cysteines of the IL-2Rγc ligand.

An IL-2Rβγc ligand can comprise an amino acid sequence selected from any one of SEQ ID NOS: 1263-1270, a substituted amino acid sequence of any one of SEQ ID NOS: 1263-1270, a truncated amino acid sequence of any one of SEQ ID NOS: 1263-1270 an amino acid sequence of any one of SEQ ID NOS: 1263-1270 having from 1 to 5 flanking glycines (SEQ ID NO: 9430) on the N-terminus and/or the C-terminus, an amino acid sequence having greater than 60% sequence similarity to any one of SEQ ID NOS: 1263-1270, or a combination of any of the foregoing.

| | |
|---|---|
| SEQ ID NO: 1263 | -GGWYPCWMAQLGELCDLDGGGGSGGVVCQDWEGVELCWQGG- |
| SEQ ID NO: 1264 | -WYPCWMAQLGELCDLDGGGGSGGVVCQDWEGVELCWQ- |
| SEQ ID NO: 1265 | -WYPCWMAQLGELCDLDGG-$X^{300}$-GGVVCQDWEGVELCWQ- |
| SEQ ID NO: 1266 | -WYPCWMAQLGELCDLD-$X^{301}\underline{X^{300}}$-VVCQDWEGVELCWQ- |
| SEQ ID NO: 1267 | -GWYPCWMAQLGELCDLDGGGGSGGVVCQDWEGVELCWQG- |
| SEQ ID NO: 1268 | -GGWYPCWMAQLGELCDLDGGGGSGGVVCQDWEGVELCWQG- |
| SEQ ID NO: 1269 | -GWYPCWMAQLGELCDLDGGGGSGGVVCQDWEGVELCWQGG- |
| SEQ ID NO: 1270 | -$(X^{301})_n$-WYPCWMAQLGELCDLD-$X^{300}$-VVCQDWEGVELCWQ-$(X^{301})_n$- | or an amino acid sequence having greater than 60%, greater than 70%, greater than 75%, greater than 80%, greater than 85%, greater than 90%, or greater than 95% sequence similarity to SEQ ID NO: 1264.

An IL-2Rβγc ligand can comprise the amino acid sequence of SEQ ID NO: 1265 (-WYPCW-MAQLGELCDLDGG-$X^{300}$-GGVVCQDWEGVELCWQ-) or can comprise an amino acid sequence having greater than 60%, greater than 70%, greater than 80%, greater than 85%, greater than 90%, or greater than 95% amino acid sequence similarity to SEQ ID NO: 1265, where $X^{300}$ can include from 1 to 20 amino acids. For example, $X^{300}$ can be selected from a peptidyl linker having an amino acid sequence of any one of SEQ ID NOS: 9380-9407 and 9420-9428. $X^{300}$ can be selected such that an IL-2Rβγc ligand of any one of SEQ ID NO: 1263-1265 or an amino acid sequence having greater than 60%, greater than 70%, greater than 75%, greater than 80%, greater than 85%, greater than 90%, or greater than 95% sequence similarity to any one of SEQ ID NO: 1263-1265 is an agonist for IL-2R or a partial agonist of IL-2R.

An IL-2Rβγc ligand can comprise the amino acid sequence of SEQ ID NO: 1266 (-WYPCW-MAQLGELCDLD-$X^{300}$-VVCQDWEGVELCWQ-) or an amino acid sequence having greater 60%, greater than 70%, greater than 80%, greater than 85%, greater than 90%, or greater than 95% amino acid sequence similarity to SEQ ID NO: 1266, where $X^{300}$ includes from 1 to 30 amino acids. $X^{300}$ can be selected such that an IL-2Rβγc ligand of SEQ ID NO: 1266 or an amino acid sequence having greater than 60%, greater than 70%, greater than 75%, greater than 80%, greater than 85%, greater than 90%, or greater than 95% sequence similarity to SEQ ID NO: 1266 is an agonist for IL-2R or a partial agonist of IL-2R.

In IL-2Rβγc ligands of any one of SEQ ID NO: 1263-1270 or an amino acid sequence having greater than 60%, greater than 70%, greater than 75%, greater than 80%, greater than 85%, greater than 90%, or greater than 95% sequence similarity to any one of SEQ ID NO: 1263-1270, the cysteines of the IL-2Rβ ligand can be bound together through a disulfide bond, and the cysteines of the IL-2Rγc In an IL-2Rβγc ligand having an amino acid sequence of any one of SEQ ID NOS: 1265 and 1270, $X^{300}$ can include from 1 to 20 amino acids. For example, $X^{300}$ can be selected from having an amino acid sequence of any one of SEQ ID NOS: 9380-9407. For example, $X^{300}$ can be GGS (SEQ ID NO: 9402) or GGGGSGG (SEQ ID NO: 9404). For example, $X^{300}$ can be selected from a peptidyl linker having an amino acid sequence of any one of SEQ ID NOS: 9420-9428.

In ligands having SEQ ID NOS: 1266 and 1270, each $X^{301}$ can independently comprise a flanking amino acid such as a glycine, where each n is independently an integer from 0 to 5.

An IL-2Rβγc ligand having an amino acid sequence of any one of SEQ ID NOS: 1263-1270, the cysteines of the IL-2Rβ ligand can be bound together through a disulfide bond, and the cysteines of the Rγc ligand can be bound together through a disulfide bond. In certain IL-2Rβγc ligands, the cysteines of the IL-2Rβ ligand can be bound to the cysteines of the Rγc ligand.

An IL-2Rβγc ligand can have greater than 60%, greater than 70%, greater than 75%, greater than 80%, greater than 85%, greater than 90%, or greater than 95% sequence similarity to any one of SEQ ID NOS: 1263-1270.

An IL-2Rβγc ligand can comprise an amino acid sequence selected from any one of SEQ ID NOS: 4070-4085, a substituted amino acid sequence of any one of SEQ ID NOS: 4070-4085, a truncated amino acid sequence of any one of SEQ ID NOS: 4070-4085, an amino acid sequence of any one of SEQ ID NOS: 4070-4085 having from 1 to 5 flanking glycines (SEQ ID NO: 9430) on the N-terminus and/or the C-terminus, an amino acid sequence having greater than 60% sequence similarity to any one of SEQ ID NOS: 4070-4085, or a combination of any of the foregoing.

| | | |
|---|---|---|
| SEQ ID NO: 4070 | GGWYPCWIARVGELCDLEEGPVNRGGGGSGGVVCQDWEGVELCWQGG | |
| SEQ ID NO: 4071 | GGAVEFYPCWLARIGELCDLVEPGGGGSGGVVCQDWEGVELCWQGG | |
| SEQ ID NO: 4072 | GGWYPCWIARVGELCDMEGGGGSGGVVCQDWEGVELCWQGG | |
| SEQ ID NO: 4073 | GGEWFHDCFLAKVGDLCDLFLWGGGGSGGVVCQDWEGVELCWQGG | |
| SEQ ID NO: 4074 | GGRYVHDCFIAQVGDLCDLFLHGGGGSGGVVCQDWEGVELCWQGG | |
| SEQ ID NO: 4075 | GGRSLVDCFLVKVGDLCDFFNWGGGGSGGVVCQDWEGVELCWQGG | |
| SEQ ID NO: 4076 | GGWYPCWIARVGELCDLEGGGGSGGVVCQDWEGVELCWQGG | |
| SEQ ID NO: 4077 | GGWYPCWLAQVGELCDLDGGGGSGGVVCQDWEGVELCWQGG | |
| SEQ ID NO: 4078 | GGWYPCWIARVGELCDLEEGPVNRGGGGSGGGGSGGVVCQDWEGVELCWQGG | |
| SEQ ID NO: 4079 | GGWYPCWIARVGELCDLEEGPVNRGGGGSGGGGSGGGGSGGVVCQDWEGVELCWQGG | |
| SEQ ID NO: 4080 | GGRYVHDCFIAQVGDLCDLFLHGGGGSGGGGSGGVVCQDWEGVELCWQGG | |
| SEQ ID NO: 4081 | GGRYVHDCFIAQVGDLCDLFLHGGGGSGGGGSGGGGSGGVVCQDWEGVELCWQGG | |
| SEQ ID NO: 4082 | GGRYVHDCFIAQVGDLCDLFLHGGGGSGGGGSGGGGSGGGGSGGVVCQDWEGVELCWQGG | |
| SEQ ID NO: 4083 | GGLVDCFKVKVGELCDLFGGGGSGGVVCQDWEGVELCWQGG | |
| SEQ ID NO: 4084 | GGRYVHDCFIAQVGDLCDLFLHGGGGSGGVVCQDWEGVELCWQGG | |
| SEQ ID NO: 4085 | GGWYSCWMAQLGELCDLDGGGGSGGVVCQDWEGVELCWQGG | |

An IL-2Rβγc ligand having an amino acid sequence of any one of SEQ ID NOS: 4070-4085, the cysteines of the IL-2Rβ ligand can be bound together through a disulfide bond, and the cysteines of the Rγc ligand can be bound together through a disulfide bond. In certain IL-2Rβγc ligands, the cysteines of the IL-2Rβ ligand can be bound to the cysteines of the Rγc ligand.

An IL-2Rβγc ligand can have greater than 60%, greater than 70%, greater than 75%, greater than 80%, greater than 85%, greater than 90%, or greater than 95% sequence similarity to any one of SEQ ID NOS: 4070-4085.

In IL-2Rβγc ligand having SEQ ID NOS: 4070-4085 the ligand linker can be another ligand linker such as any of those disclosed herein.

An IL-2Rβγc ligand can have the amino acid sequence of any one of SEQ ID NOS: 4090-4094.

| | |
|---|---|
| SEQ ID NO: 4090 | Ac-WYPCWMAQLGELCDLDGGGGSGGVVCQDWEGVELCWQ-OH |
| SEQ ID NO: 4091 | Ac-WYPCWMAQLGELCDLDGGGGSGGVVCQDWEGVALCWQ-OH |
| SEQ ID NO: 4092 | Ac-WYPCW(Abu)AQLGELCDLDGGGGSGGVVCQDWEGVELCWQ-OH |
| SEQ ID NO: 4093 | Ac-WYPCW(Abu)AQLGELCDLDGGGGSGGVVCQDWEGVALCWQ-OH |
| SEQ ID NO: 4094 | Ac-WYPCWMAQLGELCDLDGGGGSGGVVCQDWEGVELCWQ-OH |

An IL-2Rβγc ligand having the amino acid sequence of any one of SEQ ID NOS: 4090-4094 can bind the hIL-2Rβ and hIL-2Rγc subunits with an IC50 of less than 100 μM.

An IL IL-2Rβγc ligand can have the amino acid sequence of anyone of SEQ ID NOS: 4095-4099.

| | |
|---|---|
| SEQ ID NO: 4095 | Ac-GGELLVDCFKVKVGELCDLFFGGGGSGGVVCQDWEGVELCWQGG-OH |
| SEQ ID NO: 4096 | Ac-GGRYVHDCFIAQVGDLCDLFLHGGGGSGGVVCQDWEGVELCWQGG-OH |
| SEQ ID NO: 4097 | Ac-GGKWVHDCFLAKVGDVCDLFVVGGGGSGGVVCQDWEGVELCWQGG-OH |
| SEQ ID NO: 4098 | Ac-GGRSLVDCFLVKVGDLCDFFNWGGGGSGGVVCQDWEGVELCWQGG-OH |
| SEQ ID NO: 4099 | Ac-GGEWFHDCFLAKVGDLCDLFLWGGGGSGGVVCQDWEGVELCWQGG-OH |

An IL-2Rβγc ligand having the amino acid sequence of any one of SEQ ID NOS: 4095-4099 can bind the hIL-2Rβ subunit and to the hIL-2Rγc subunit with an IC50 of less than 100 µM.

Certain IL-2Rβγc ligands having an amino acid sequence of any one of SEQ ID NOS: 1263-1270, 4070-4085, and 4090-4099 can bind the hIL-2Rβ subunit, to the hIL-2Rγc subunit, to the cyno-IL-2Rβ subunit, and to the cyno-IL-2Rγc subunit with an IC50 of less than 100 µM.

An IL-2Rβγc ligand provided by the present disclosure can bind to IL-2R such as human IL-2R with an $IC_{50}$ from 1 pM to 100 µM, from 10 pM to 10 µM, from 100 pM to 1 µM, from 0.001 µM to 1 µM, or from 0.01 µM to 1 µM.

An IL-2Rβγc ligand provided by the present disclosure can bind to IL-2R such as human IL-2R with an $IC_{50}$ of less than 100 µM, less than 10 µm, less than 1 µm, less than 100 pM, less than 10 pM, or less than 1 pM.

An IL-2Rβγc ligand provided by the present disclosure can bind to each of the IL-2Rβ subunit and to the IL-2Rγc subunit, such as each of the human IL-2Rβ subunit and the human IL-2Rγc subunit, with an $IC_{50}$ from 1 pM to 100 µM, from 10 pM to 10 µM, from 100 pM to 1 µM, from 0.001 µM to 1 µM, or from 0.01 µM to 1 µM.

An IL-2Rβγc ligand provided by the present disclosure can bind to each of the IL-2Rβ subunit and the IL-2Rγc subunit, such as each of the human IL-2Rβ subunit and to the human IL-2Rγc subunit with an $IC_{50}$ of less than 100 µm, less than 10 µm, less than 1 µm, less than 100 pM, less than 10 pM, or less than 1 pM.

An IL-2Rγc ligand provided by the present disclosure can exhibit an $EC_{50}$ for STAT5 phosphorylation in TF-1β cells and/or NK-92 cells, for example, of less than 100 µM, less than 10 µM, less than 1 µM, less than 100 pM, less than 10 pM, or less than 1 pM.

An IL-2Rγc ligand provided by the present disclosure can exhibit an $EC_{50}$ for STAT5 phosphorylation in TF-1β cells and/or NK-92 cells, for example, from 1 µM to 100 µM, from 10 pM to 10 µM, from 100 pM to 1 µM, from 0.001 µM to 1 µM, or from 0.01 µM to 1 µM.

Solid tumors exhibit metabolic differences from normal tissues. The greater reliance of solid tumors on glycolytic metabolism, produces a more acidic tumor microenvironment. For example, the solid tumor microenvironment can have a pH that is from 1 pH to 2 pH units less than that of most normal tissue. This pH differential can be exploited to enhance the activity of therapeutic agents in solid tumors relative to activity in normal peripheral tissue.

Using suitable pH-selective screening methods, IL-2Rβ and IL-2Rγc ligands can be identified that bind to IL-2R at low pH with an $IC_{50}$ that is less than the $IC_{50}$ for binding at a neutral pH. For example, the $IC_{50}$ for binding at a pH less than 6 can be at least 10 time or at least 100 times less than the $IC_{50}$ for binding at a pH greater than 6. These pH-biased IL-2Rβ and/or IL-2Rγc ligands can be incorporated into an IL-2Rβγc ligand to provide a pH-biased IL-2Rβγc ligand.

IL-2Rβγc ligands can comprise a pH-biased IL-2Rβ ligand and/or a pH-biased IL-2Rγc ligand. These pH-biased IL-2Rβγc ligands can exhibit an enhanced therapeutic index with respect to increased cytotoxicity targeting solid tumors and with reduced toxicity to normal tissue.

An IL-2Rβγc ligand comprising a pH-biased IL-2Rβ ligand and/or a pH-biased IL-2Rβγc ligand can exhibit a pH-biased binding affinity ($IC_{50}$) to the IL-2Rβ subunit and/or to the IL-2Rγc subunit.

For example, a pH-biased IL-2Rβγc ligand can bind to IL-2R, such as human IL-2R, at pH 6 with an $IC_{50}$ at least at least 10% less than the $IC_{50}$ for binding to IL-2R, such as human IL-2R, at pH 7.5, at least 25% less, at least 50% less, at least 100% less, or at least 200% less than the $IC_{50}$ for binding to IL-2R, such as human IL-2R, at pH 7.5.

A pH-biased IL-2Rβγc ligand can bind to IL-2R, such as human IL-2R, at pH 6.0 with an $IC_{50}$ from 1 µM to 100 µM; and bind to IL-2R, such as human IL-2R, with an $IC_{50}$ greater than 100 µM at pH 7.5.

A pH-biased IL-2Rβγc ligand can bind to IL-2Rγc, such as human IL-2Rγc, at pH 6.0 with an $IC_{50}$ from 0.1 µM to 50 µM; and bind to IL-2Rγc, such as human IL-2Rγc with an $IC_{50}$ greater than 100 µM at pH 7.5.

A pH-biased IL-2Rβγc ligand can bind to IL-2Rγc, such as human IL-2Rβγc at pH 6.0 with an $IC_{50}$ of less than 100 µM; and bind to IL-2Rγc, such as human IL-2Rγc with an $IC_{50}$ greater than 100 µM at pH 7.5.

A pH-biased IL-2Rβγc ligand can bind to each of the IL-2Rβ subunit and to the IL-2Rγc subunit, such as the human IL-2Rβ subunit and the IL-2Rγc subunit, with an $IC_{50}$ of less than 100 µM at pH 6, and bind to each of the IL-2Rβ subunit and to the IL-2Rγc subunit, such as the human IL-2Rβ subunit and the IL-2Rγc subunit, with an $IC_{50}$ greater than 100 µM at pH 7.5.

pH-Biased IL-2Rβγc ligands can be useful, for example, to selectively activate cell expressing IL-2R in low pH cell environments such as in solid tumors compared to cells in neutral and high pH environments.

Using suitable pH-selective screening methods, pH-biased IL-2Rβγc ligands can be identified that have a higher binding affinity (lower $IC_{50}$) to IL-2R at lower pH and a lower binding affinity (higher $IC_{50}$) at a neutral pH. IL-2Rβγc ligands, tandem IL-2Rγc ligands, and IL-2Rβγc ligand constructs can include one or more pH-biased IL-2Rβ ligands and/or one or more pH-biased IL-2Rγc ligands. These pH-biased IL-2Rβγc ligands, pH-biased tandem IL-2Rβγc ligands, and pH-biased IL-2Rβγc ligand constructs can exhibit an enhanced therapeutic index reflecting increased cytotoxicity for targeting solid tumors and with reduced toxicity to normal tissue.

Similarly, using pH-selective functional screening methods IL-2Rβγc ligands and IL-2Rβγc ligand constructs can be selected that exhibit enhanced IL-2R agonist activity a lower pH such as at pH 6 compared to higher pH such as at pH 7. For example, pH-biased IL-2Rβγc ligands provided by the present disclosure can provide a lower $EC_{50}$ for STAT5 phosphorylation in TF-1β cells and/or NK-92 cells at pH 6.0 relative to the $EC_{50}$ for the same IL-2Rγc ligand at pH 7.5. Such pH-biased IL-2Rβγc ligands exhibit enhanced IL-2R agonist activity or partial agonist activity at lower pH.

For example, a pH-biased IL-2Rβγc ligand can exhibit an $EC_{50}$ for STAT5 phosphorylation in TF-1β and NK-92 cells at pH 6 that is at least 10% less than the $EC_{50}$ for STAT5 phosphorylation in TF-1β and NK-92 cells at pH 7.5, at least 25% less, at least 50% less, at least 100% less, or at least 200% less than the $EC_{50}$ for STAT5 phosphorylation in TF-1β and NK-92 cells at pH 7.5.

Using pH-selective screening methods similar to those described in the examples, pH-biased IL-2Rβ ligands and/or IL-2Rγc ligands having other pH biases, such as other pH-biased functional properties or decreased $IC_{50}$ or $EC_{50}$ at pH values greater than normal healthy tissue, can be identified and incorporated into IL-2Rβγc ligands to provide additional biased IL-2Rβγc ligands and IL-2Rβγc ligand constructs.

Tandem IL-2Rβγc ligands provided by the present disclosure can comprise two or more IL-2Rβγc ligands. The two or more IL-2Rβγc ligands can be bound together to form a linear or non-linear structure. For example, a tandem IL-2Rβγc ligand can have the structure of Formula (8a) or Formula (8b):

$$BGL\text{-}(\text{-}L_{t1}\text{-}BGL\text{-})_{n1}\text{-}L_{t1}\text{-}BGL \quad (8a)$$

$$L_{t2}\{(\text{-}L_{t1}\text{-}BGL\text{-})_{n2}\text{-}L_{t1}\text{-}BGL\}_{p} \quad (9b)$$

where,
each BGL is independently selected from an IL-2Rβγc ligand; and
$L_{t1}$ is a divalent tandem linker;
$L_{t2}$ is a p-valent tandem linker;
n1 is an integer from 1 to 6; and
n2 is an integer from 0 to 6; and
p is an integer from 3 to 8.

In tandem IL-2Rβγc ligands of Formula (8a) and (8b), each IL-2Rβγc ligand can be the same.

In tandem IL-2Rβγc ligands of Formula (8a) and (8b), at least one IL-2Rβγc ligand can be different than another IL-2Rβγc ligand.

In tandem IL-2Rβγc ligands of Formula (8a) and (8b), each IL-2Rβγc ligand can independently be bound to a tandem linker through the N-terminus or through the C-terminus of the respective IL-2Rβγc ligand.

In tandem IL-2Rβγc ligands of Formula (8a) and (8b), each of the IL-2Rβγc ligands can comprise one or more flanking amino acids.

A tandem linker, $L_{t1}$ and $L_{t2}$, can be a peptidyl tandem linker and can, for example, from 1 to 50 amino acids, from 2 to 40 amino acids, or from 5 to 30 amino acids.

A tandem linker can comprise a chemical linker such as a triazole-containing linker provided by the present disclosure.

Each divalent tandem linker $L_{t1}$ can be the same as each of the other divalent tandem linkers, or at least one of the divalent tandem linkers can be different than another tandem linker.

In a tandem IL-2Rβγc ligand of Formula (8a), n can be, for example, 1, 2, 3, 4, 5, or 6.

In a tandem IL-2Rβγc ligand of Formula (8b), each n can independently be selected from 0, 1, 2, 3, 4, 5, or 6.

In a tandem IL-2Rβγc ligand of Formula (8b), p can be, for example, 3, 4, 5, 6, 7, or 8.

A p-valent tandem linker can comprise any suitable polyfunctional chemical moiety. For example, tandem IL-2Rβγc ligands of Formula (8a) and (8b) can have a molecular weight less than 10,000 Da, less than 6,000 Da, less than 2,000 Da, less than 1,000 Da, or less than 500 Da.

An IL-2Rβγc ligand provided by the present disclosure can be bound to a naturally occurring protein or to a synthetic molecule to provide an IL-2Rβγc ligand construct. Examples of suitable construct partners include polymers, proteins, Fc-fragments, immunoglobulin fragments, and antibodies.

An IL-2Rβγc ligand construct can be configured to provide desired pharmacokinetic properties, provide reduced immunogenicity, to target a specific cell population, and/or to provide enhanced therapeutic efficacy.

An IL-2Rβγc ligand can be bound to the construct partner through a construct linker.

An IL-2Rβγc ligand construct can comprise a single IL-2Rβγc ligand bound to a construct partner or two or more IL-2Rβγc ligands bound to a construct partner.

Each of the two or more IL-2Rβγc ligands bound to a construct partner can be the same, or at least one of the IL-2Rβγc ligands can be different than at least one of the other IL-2Rβγc ligands bound to the construct partner. The IL-2Rβγc ligands can differ, for example, with respect to the IL-2Rβ ligand, the IL-2Rγc ligand, the IL-2Rβγc ligand linker, and/or to the flanking amino acids.

Each of the IL-2Rβγc ligands can be independently bound to a construct partner through a respective construct linker. Each of the respective construct linkers can be the same, or at least one of the construct linkers can be different than at least one other construct linker. The construct linkers can differ, for example, with respect to the length and/or to the chemical composition.

Each of the IL-2Rβγc ligands can independently be bound to a construct partner through the N-terminus or the C-terminus of the respective IL-2Rβγc ligand.

An IL-2Rβγc ligand construct can comprise a tandem IL-2Rβγc ligand bound to a construct partner. The tandem IL-2Rβγc ligand can be bound to the construct partner through a construct linker.

An IL-2Rβγc ligand construct can comprise a single tandem IL-2Rβγc ligand bound to a construct partner or two or more tandem IL-2Rβγc ligands bound to a construct partner.

Each of the two or more tandem IL-2Rβγc ligands bound to a construct partner can be the same, or at least one of the tandem IL-2Rβγc ligands can be different than at least one of the other tandem IL-2Rβγc ligands bound to the construct partner. The tandem IL-2Rβγc ligands can differ, for example, with respect to the IL-2Rβ ligands, the IL-2Rγc ligands, the IL-2Rβγc ligand linkers, the tandem linkers, and/or the flanking amino acids.

Each of the tandem IL-2Rβγc ligands can be bound to a construct partner through a respective construct linker. Each of the respective construct linkers can be the same, or at least one of the construct linkers can be different than at least one other construct linker. The construct linkers can differ, for example, with respect to the length and/or to the chemical composition.

Each of the tandem IL-2Rβγc ligands can independently be bound to the construct partner through the N-terminus or the C-terminus of the respective tandem IL-2Rβγc ligand.

An IL-2Rβγc ligand construct can comprise at least one IL-2Rβ ligand and at least one tandem IL-2Rγc ligand bound to a construct partner. Each of the at least one IL-2Rβ ligand and the at least one IL-2Rγc ligand can independently be bound to the construct partner through a construct linker. For example, an IL-2Rβγc ligand construct can comprise from 1 to 10 IL-2Rβ ligands provided by the present and from 1 to 10 IL-2Rγc ligands provided by the present disclosure.

An IL-2Rβγc ligand construct can comprise, for example, at least one IL-2Rβγc ligand, at least one tandem IL-2Rβγc ligand, at least one IL-2Rβ ligand, and/or at least one IL-2Rγc ligand, providing that the IL-2Rβγc ligand comprises at least one IL-2Rβ ligand and at least one IL-2Rγc ligand.

An IL-2Rβγc ligand construct can compromise one or more IL-2Rβγc ligands bound to a side chain of a molecule such as an amino acid forming a polymer or protein.

An IL-2Rβγc ligand construct can compromise one or more IL-2Rβγc ligands in which the one or more IL-2Rβγc ligands is incorporated into the backbone of the polymer or polypeptide. Thus, an IL-2Rβγc ligand construct can comprise one or more IL-2Rβγc ligands in which the one or more IL-2Rβγc ligands are bound to a N-terminus of a polypeptide, bound to a C-terminus of a polypeptide, bound to an amino acid side chain of a polypeptide, and/or incorporated into the amino acid sequence of the polypeptide.

IL-2Rβγc ligand constructs provided by the present disclosure include fusion proteins.

Examples of suitable fusion protein partners include Fc-fragments, immunoglobulins such as IgG1, IgG2, and IgG4, immunoglobulin fragments such as IgG1, IgG2, and IgG4 fragments, naturally occurring proteins such as human serum albumin (HSA), antibodies, other human proteins and mutants and/or variants thereof; proteins, and polypeptides. A fusion protein partner can be a naturally occurring protein, a modified-naturally occurring protein, or a synthetic protein.

A fusion partner can be used to provide a desirable pharmacokinetic profile, for cell-targeting, for dual pharmacology, and/or for enhancing therapeutic efficacy.

For example, an IL-2Rβγc ligand provided by the present disclosure can be fused to a protein that increases the circulating half-life of the IL-2Rβγc ligand. Fusions of therapeutic proteins with IgG or the IgG-Fc chain can accomplish this by increasing the hydrodynamic radius of the protein, thus reducing renal clearance, and through Neonatal Fc Receptor (FcRn)-mediated recycling of the fusion protein, thus prolonging the circulating half-life. Other fusion proteins can be designed to tailor properties such as the pharmacokinetics, biodistribution, pharmacodynamics, pharmacology, cytotoxicity, selectivity, and/or targeting.

An IL-2Rβγc ligand fusion protein provided by the present disclosure can comprise one or more IL-2Rβγc ligands bound to a fusion protein partner. Each of the one or more IL-2Rβγc ligands can be independently bound to a fusion protein partner through the N-terminus or through the C-terminus of the respective IL-2Rβγc ligand. Each of the one or more IL-2Rβγc ligands can be the same. At least one of the one or more IL-2Rβγc ligands can be different than at least one other IL-2Rβγc ligand. The amino acid sequence at the junction between an IL-2Rβγc ligand and a fusion partner protein can be either a direct fusion of the two protein sequences or can be a fusion with an intervening peptidyl fusion (construct) linker. Peptidyl linkers can be included as spacers between an IL-2Rβγc ligand and the fusion partner. Peptidyl linkers can promote proper protein folding and stability of the component protein and the one or more IL-2Rβγc ligands, improve protein expression, and/or can enhance bioactivity of the IL-2Rβγc ligand and/or the fusion partner.

Peptidyl linkers used in IL-2Rβγc ligand fusion proteins can be designed to be unstructured flexible peptides. Peptidyl linkers can be, for example, rich in glycine and serine, such as repeats of a sequence such as, for example, a peptidyl linker having any one of SEQ ID NOS: 9380-9401, where n is an integer from 1 to 10. A flexible peptidyl linker with a fully extended β-strand conformation can have an end-to-end length, for example, of 3.5 Å per residue. Thus, a peptidyl linker of 5, 10, 15, or 10 residues can have a maximum fully extended length of 17.5 Å, 35 Å, 52.5 Å, 70 Å, 140 Å, or more than 140 Å, respectively.

Peptidyl linkers can be rigid linkers, such as linkers including proline and other amino acids such as alanine, lysine or glutamic acid. For example, a rigid linker can have an amino acid sequence of any one of SEQ ID NOS: 9420-9425. A peptidyl linker can facilitate providing an appropriate conformation and orientation of individual fusion protein moieties to facilitate the engagement of an IL-2Rβγc ligand with the IL-2Rβ subunit and/or IL-2Rγc subunit of IL-2R, facilitate binding of the IL-2Rβγc ligand to IL-2R, enable fusion protein recycling, and/or prolong the circulating half-life of the IL-2Rβγc ligand.

There are multiple options for the design and construction of a fusion protein comprising one or more IL-2Rβγc ligands and which can be selected to obtain an IL-2Rβγc fusion protein having the desired biological activity and pharmaceutical characteristics. Design options include, for example, the IL-2Rβγc ligand including the selection of the IL-2Rβ ligand, the IL-2Rγc ligand, and the IL-2Rβγc ligand linker; the fusion partner protein binding moiety; the configuration of the fusion partner binding moiety in the fusion protein; the peptidyl linker binding an IL-2Rβγc ligand to the fusion partner; and the fusion partner protein.

In general, preparation of IL-2Rβγc ligand fusion proteins provided by the present disclosure can be prepared using recognized recombinant DNA techniques involving, for example, polymerase chain amplification reactions (PCR), preparation of plasmid DNA, cleavage of DNA with restriction enzymes, preparation of oligonucleotides, ligation of DNA, isolation of mRNA, introduction of the DNA into a suitable cell, transformation or transfection of a host, and culturing of the host. Additionally, IL-2Rβγc ligand fusion proteins can be isolated and purified using chaotropic agents and using well-known electrophoretic, centrifugation, and chromatographic methods.

IL-2Rβγc ligand fusion proteins provided by the present disclosure can comprise one or more small ubiquitin-related modifier (SUMO) proteins. Modification of cellular proteins by the ubiquitin-like modifier SUMO can regulate various cellular processes, such as nuclear transport, signal transduction, and stabilization of proteins. Once covalently attached to cellular targets, SUMO regulates protein/protein and protein/DNA interactions, as well as localizes and stabilizes the target protein.

For example, an IL-2Rβγc ligand can be bound to a first linker, which is bound to a SUMO protein, which is further bound to a second linker binding the SUMO protein to a fusion partner such as an IgG or Fc-fragment. SUMO fusions can enhance expression, promote solubility, and/or facilitate optimized protein folding. Attachment of a highly stable structure such as that of ubiquitin or SUMO at the N- or C-terminus of a fusion partner protein can increase the yield by increasing stability. The solubilizing effect of ubiquitin and ubiquitin-like proteins may also be explained in part by the outer hydrophilicity and inner hydrophobicity of the core structure of ubiquitin and SUMO, exerting a detergent-like effect on otherwise insoluble proteins.

One or more IL-2Rβγc ligands can be bound to a construct partner that provides desired pharmacokinetic properties. For example, one or more IL-2Rβγc ligands can be bound to a synthetic polymer or to a protein, such as a naturally occurring protein, that exhibits an extended half-life in the systemic circulation.

An IL-2Rβγc ligand provided by the present disclosure can be conjugated to or fused to molecules that extend the serum half-life of the IL-2Rγc ligand without increasing the risk that such half-life extension would increase the likelihood or the intensity of a side-effect or adverse event in a patient. Dosing of extended serum half-life IL-2Rβγc ligands can allow for prolonged target coverage with lower systemic maximal exposure ($C_{max}$). Extended serum half-life can allow for use of lower administered doses and/or a less frequent dosing regimen of an IL-2Rβγc ligand or IL-2Rβγc ligand construct.

The serum half-life of an IL-2Rβγc ligand can be extended by any suitable method. Such methods include linking an IL-2Rβγc ligand to a peptide that binds to the neonatal Fc receptor or linking an IL-2Rβγc ligand to a protein having extended serum half-life such as IgG, an IgG Fc fragment or to human serum albumin (HSA).

Examples of IL-2Rβγc ligand pharmacokinetic constructs include, (a) recombinantly fusing one or more IL-2Rβγc ligands to a naturally long-half-life protein or protein domain such as Fc fusion, transferrin fusion or albumin fusion; (b) recombinantly fusing one or more IL-2Rβγc ligands to an inert polypeptide such as XTEN®, a homoamino acid polymer (HAP, HAPylation), a proline-alanine-serine polymer (PAS, PASylation), an elastin-like peptide (ELP, ELPylation), or a gelatin-like protein GLK polymer; (c) increasing the hydrodynamic radius by chemical conjugation of one or more IL-2Rβγc ligands to a repeat chemical moiety such as PEGylation or hyaluronic acid; (d) increasing the negative charge of the one or more IL-2Rβγc ligands by polysialylation or by fusing to a negatively charged highly sialylated peptide such as carboxy-terminal peptide (CTP of chorionic gonadotropin (CG) 0-chain); or (e) conjugating of one or more IL-2Rβγc ligands to a peptide or protein-binding domain of a normally long half-life protein such as human serum albumin (HSA), transferrin, fusion to the constant fragment Fc chain of a human immunoglobulin IgG, or fusion to non-natural polypeptides such as XTEN®.

One or more IL-2Rβγc ligands can be bound to a synthetic polymer.

For example, an IL-2Rβγc ligands can be conjugated to polyethylene glycol (PEG) chains (to extend the half-life of the IL-2Rβγc ligand in the systemic circulation. A PEG can have a molecular weight, for example, from 5 kDa to 100 kD, from 10 kDa to 80 kDa, or from 20 kDa to 60 kDa.

PEGylation can be achieved chemically or enzymatically and the biophysical and biochemical properties of the conjugate can depend, for example, on structure, size, number and location of PEG chains. PEGylation can prolong the circulation half-life of an IL-2Rβγc ligand by masking proteolytic cleavage sites and/or by increasing the effective hydrodynamic radii of the ligands, thereby reducing renal clearance.

An IL-2Rβγc ligand can be conjugated to either linear or branched-chain monomethoxy polyethylene glycol (mPEG), resulting in increases in the molecular mass and hydrodynamic radius and decrease the rate of glomerular filtration by the kidney. PEG is a highly flexible uncharged, mostly non-immunogenic, hydrophilic, and non-biodegradable molecule, which generates a larger hydrodynamic radius than an equivalently sized protein. PEGylation has been used widely to lengthen the half-life of pharmacologically active compounds.

Similar to IgG, serum albumin displays an unusually long circulation half-life. Half-life prolongation of these functionally and structurally unrelated proteins is derived primarily from interaction with FcRn. Although HSA binds FcRn at a different site than IgG, both interactions are pH-dependent and result in FcRn-mediated rescue from cellular catabolism. IL-2Rβγc ligand constructs capable of extending the circulation half-life include, for example, genetic fusion to HSA, conjugation to HSA-binding moieties, and fusion to HSA-bonding antibodies or antibody fragments.

One or more IL-2Rβγc ligands can be bound to an XTEN® polypeptide (Amunix Pharmaceuticals Inc.). XTEN® polypeptides are generally 200 amino acids or more in length, are designed to mask antigen binding regions of scFvs, to be unstructured and to have a low immunogenicity. XTEN® polypeptides can increase the circulating half-life of therapeutic agents. One or more IL-2Rβγc ligands can be bound to an XPAT® polypeptide (Amunix Pharmaceuticals, Inc.). XPAT® polypeptides include substrates for proteases and can be designed to be active with one or more proteases, to select the cleavage rate, and to impart specificity.

Genetic fusing of one or more IL-2Rβγc ligands to serum transferrin (Tf) can result in enhanced pharmacokinetics. Serum transferrin is an 80 kDa glycoprotein that mediates iron transport from the systemic circulation into cells and tissues. When bound to ferric ions, transferrin displays high affinity for the transferrin receptors (TfRs) displayed on the surface of most cell types. Upon interaction, the Tf/TfR complex is internalized via receptor-mediated endocytosis into endosomes, where iron is released and Tf/TfR is then recycled to the cell surface. Fusion of protein therapeutics to Tf or TfR-binding antibodies can be used for half-life extension, targeting of malignant cells overexpressing TfRs and targeting of the rai capillary endothelium for transport of therapeutics across the blood brain barrier.

Fusion of an IL-2Rβγc ligand to IgG or Fc can result in increased avidity of the IL-2Rβγc ligand provides for purification via protein G./A affinity chromatography and can prolong the circulation half-life of the IL-2Rβγc ligand.

Half-life extension of IL-2Rβγc ligand/IgG fusion proteins results from a combination of reduced renal clearance due to increased molecular size and FcRn-mediated recycling.

One or more IL-2Rβγc ligands can be bound to any suitable IgG including, for example, IgG1, IgG2, or IgG4. The one or more IL-2Rβγc ligands can be bound to any suitable portion of IgG such as the light chain VL or to the heavy chain VH and including the N-terminus, the C-terminus, an amino acid side chain, or can be incorporated into the amino acid sequence of the light or heavy chain of IgG.

IL-2Rβγc ligand constructs provided by the present disclosure can comprise IL-2Rβγc ligand/IgG constructs.

An IgG construct comprises at least one heavy chain and at least one light chain. An IL-2Rβγc ligand can be bound to the N-terminus of the heavy chain, to the N-terminus of the light chain, or to the N-terminus of the heavy chain, and to the N-terminus of the light chain.

An IL-2Rβγc ligand can be bound to the C-terminus of the heavy chain, for example, to the CH3 domain, to the N-terminus of the heavy chain and/or to the N-terminus of the light chain.

In an IgG construct, an IL-2Rβγc ligand can be bound to the N-terminus of one or both heavy chains, to the N-terminus of one or both light chains, and/or to one or both C-termini of the heavy chains.

In an IgG construct, an IL-2Rβγc ligand can be bound to an amino acid side chain of IgG.

In an IgG construct, an IgG heavy chain and/or an IgG light chain can comprise one or more IL-2Rβγc ligands incorporated into the amino acid sequence forming the IgG heavy chain and/or the IgG light chain.

Examples of IL-2Rβγc ligand IgG constructs are shown in FIGS. 20A-20J.

In an IL-2Rβγc construct each linker bonding an IL-2Rβγc ligand to the IgG can independently be the same or can be different.

For example, an IL-2Rβγc ligand can be bound to the C-terminus of one or both IgG heavy chains, to the C-terminus of one or both IgG light chains, to the N-terminus of one or both IgG heavy chains, and/or to the N-terminus of one or both IgG light chains. Examples showing IL-2Rβγc ligand constructs in which an IL-2Rβγc ligand is bound to the IgG heavy and/or light chains are shown in FIG. 20A-20J. Each of the IL-2Rβγc ligands can be bound to the IgG through a suitable construct linker.

One or more IL-2Rβγc ligands can be bound to an IgG fragment such as a single light chain VL domain, a single heavy chain VH domain or to the Fc region. The fragments can be derived from any suitable immunoglobulin such as IgA, IgD, IgE, IgG, or IgM. The fragments can be derived from any suitable IgG such as, for example, IgG1, IgG2, or IgG4.

One or more IL-2Rβγc ligands can be bound to an Fc-fragment. The Fc-fragment can be monomeric, can be dimeric, or can be a modified Fc-fragment. A dimeric Fc-fragment can comprise one or more disulfide bonds on the N-terminus. An example of a modification is a knob-into-hole modification comprising a knob modification in the CH3 domain of one of the immunoglobulin heavy chain and a hole modification in the other immunoglobulin heavy chain.

Constructs provided by the present disclosure include IL-2Rβγc ligand-Fc fusion proteins. An Fc chain can include two different polypeptides that self-assemble into either homodimeric Fc chains or heterodimeric Fc chains. The fusion proteins can include an Fc chain, one or more Fc chain linkers, and one or more IL-2Rβγc ligands. An Fc chain linker binds an IL-2Rβγc ligand provided by the present disclosure to an Fc chain.

The Fc chain can comprise the Fc chain of any suitable immunoglobulin isotype including IgA, IgD, IgE, IgG, and IgM immunoglobulin isotypes. The Fc-fragment can be derived from any suitable IgG immunoglobulin including, for example, an IgG1, IgG2, or IgG4.

An IL-2Rβγc ligand Fc-fusion protein can comprise one or more IL-2Rβγc ligands. Each of the one or more IL-2Rβγc ligands can be the same or can be different than other IL-2Rβγc ligands bound to a Fc chain.

An IL-2Rβγc ligand Fc-fragment construct, i.e., IL-2Rβγc Fc fusion, can comprise an IL-2Rβγc ligand bound to the C-terminus of one Fc-chain or to the C-terminus of both Fc-chains of the Fc-fragment.

An IL-2Rβγc ligand Fc fusion can comprise one IL-2Rβγc ligand bound to the N-terminus of the Fc-fragment or two IL-2Rβγc ligands bound to the N-terminus of the Fc-fragment.

An IL-2Rβγc ligand Fc fusion can comprise one or two IL-2Rβγc ligands bound to the C-terminus of the Fc-fragment and one or two IL-2Rβγc ligands can be bound to the N-terminus of the Fc-fragment.

Each IL-2Rβγc ligand can be covalently bound to an Fc-fragment through an Fc linker. Each Fc linker binding an IL-2Rβγc ligand to an Fc-fragment can be the same or different.

Each IL-2Rβγc ligand can independently be bound to an Fc linker through the N-terminus or through the C-terminus of the IL-2Rβγc ligand.

Examples of IL-2Rβγc ligand Fc-fragment constructs are shown in FIGS. 20A-20J and 21A-21C.

Examples of constructs comprising an IL-2Rβγc ligand bound to an hIgG1 or hIgG2 immunoglobulin Fc-fragment are provided in Table 6.

TABLE 6

| Ligand immunoglobulin constructs. |
|---|
| SEQ ID NO: 8061 hIgG2-Fc-(PA)10 IL-2Rβγc ligand<br>ERKSSVECPPCPAPPVAGPSVFLFPPKPKDTLMISRTPEVTCVVVDVSHEDPEVQFNWYVDG<br>VEVHNAKTKPREEQFNSTFRVVSVLTVVHQDWLNGKEYKCKVSNKGLPAPIEKTISKTKG<br>QPREPQVYTLPPSREEMTKNQVSLTCLVKGFYPSDIAVEWESNGQPENNYKTTPPMLDSDG<br>SFFLYSKLTVDKSRWQQGNVFSCSVMHEALHNHYTQKSLSLSPGAPAPAPAPAPAPAPA<br>PAPAGGWYPCWIARVGELCDLEEGPVNRGGGGSGGVVCQDWEGVELCWQGG |
| SEQ ID NO: 8062 hIgG2-Fc-(PA)10 IL-2Rβγc ligand<br>ERKSSVECPPCPAPPVAGPSVFLFPPKPKDTLMISRTPEVTCVVVDVSHEDPEVQFNWYVDG<br>VEVHNAKTKPREEQFNSTFRVVSVLTVVHQDWLNGKEYKCKVSNKGLPAPIEKTISKTKG<br>QPREPQVYTLPPSREEMTKNQVSLTCLVKGFYPSDIAVEWESNGQPENNYKTTPPMLDSDG<br>SFFLYSKLTVDKSRWQQGNVFSCSVMHEALHNHYTQKSLSLSPGAPAPAPAPAPAPAPA<br>PAPAGGAVEFYPCWLARIGELCDLVEPGGGGSGGVVCQDWEGVELCWQGG |
| SEQ ID NO: 8063 hIgG2-Fc-(PA)10 IL-2Rβγc ligand<br>ERKSSVECPPCPAPPVAGPSVFLFPPKPKDTLMISRTPEVTCVVVDVSHEDPEVQFNWYVDG<br>VEVHNAKTKPREEQFNSTFRVVSVLTVVHQDWLNGKEYKCKVSNKGLPAPIEKTISKTKG<br>QPREPQVYTLPPSREEMTKNQVSLTCLVKGFYPSDIAVEWESNGQPENNYKTTPPMLDSDG<br>SFFLYSKLTVDKSRWQQGNVFSCSVMHEALHNHYTQKSLSLSPGAPAPAPAPAPAPAPA<br>PAPAGGWYPCWIARVGELCDMEGGGGSGGVVCQDWEGVELCWQGG |
| SEQ ID NO: 8064 hIgG2-Fc-(PA)10 IL-2Rβγc ligand<br>ERKSSVECPPCPAPPVAGPSVFLFPPKPKDTLMISRTPEVTCVVVDVSHEDPEVQFNWYVDG<br>VEVHNAKTKPREEQFNSTFRVVSVLTVVHQDWLNGKEYKCKVSNKGLPAPIEKTISKTKG<br>QPREPQVYTLPPSREEMTKNQVSLTCLVKGFYPSDIAVEWESNGQPENNYKTTPPMLDSDG<br>SFFLYSKLTVDKSRWQQGNVFSCSVMHEALHNHYTQKSLSLSPGAPAPAPAPAPAPAPA<br>PAPAGGEWFHDCFLAKVGDLCDLFLWGGGGSGGVVCQDWEGVELCWQGG |
| SEQ ID NO: 8065 hIgG2-Fc-(PA)10 IL-2Rβγc ligand<br>ERKSSVECPPCPAPPVAGPSVFLFPPKPKDTLMISRTPEVTCVVVDVSHEDPEVQFNWYVDG<br>VEVHNAKTKPREEQFNSTFRVVSVLTVVHQDWLNGKEYKCKVSNKGLPAPIEKTISKTKG<br>QPREPQVYTLPPSREEMTKNQVSLTCLVKGFYPSDIAVEWESNGQPENNYKTTPPMLDSDG<br>SFFLYSKLTVDKSRWQQGNVFSCSVMHEALHNHYTQKSLSLSPGAPAPAPAPAPAPAPA<br>PAPAGGRYVHDCFIAQVGDLCDLFLHGGGGSGGVVCQDWEGVELCWQGG |
| SEQ ID NO: 8066 hG2-Fc-(PA)10 IL-2Rβγc ligand<br>ERKSSVECPPCPAPPVAGPSVFLFPPKPKDTLMISRTPEVTCVVVDVSHEDPEVQFNWYVDG<br>VEVHNAKTKPREEQFNSTFRVVSVLTVVHQDWLNGKEYKCKVSNKGLPAPIEKTISKTKG<br>QPREPQVYTLPPSREEMTKNQVSLTCLVKGFYPSDIAVEWESNGQPENNYKTTPPMLDSDG<br>SFFLYSKLTVDKSRWQQGNVFSCSVMHEALHNHYTQKSLSLSPGAPAPAPAPAPAPAPA<br>PAPAGGRSLVDCFLVKVGDLCDFFNWGGGGSGGVVCQDWEGVELCWQGG |

TABLE 6-continued

Ligand immunoglobulin constructs.

SEQ ID NO: 8067 hIgG2-Fc-(PA)10 IL-2Rβγc ligand
ERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKG
QPREPQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGAPAPAPAPAPAPAPAPA
PAPAGGWYPCWIARVGELCDLEGGGGSGGVVCQDWEGVELCWQGG SEQ ID NO: 8068 hIgG2-Fc-(PA)10 IL-2Rβγc ligand
ERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKG
QPREPQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGAPAPAPAPAPAPAPAPA
PAPAGGWYPCWLAQVGELCDLDGGGGSGGVVCQDWEGVELCWQGG SEQ ID NO: 8069 hIgG2-Fc-(PA)10 IL-2Rβγc ligand
ERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKG
QPREPQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGAPAPAPAPAPAPAPAPA
PAPAGGWYPCWIARVGELCDLEEGPVNRGGGGSGGGGSGGVVCQDWEGVELCWQGG SEQ ID NO: 8070 hIgG2-Fc-(PA)10 IL-2Rβγc ligand
ERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKG
QPREPQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGAPAPAPAPAPAPAPAPA
PAPAGGWYPCWIARVGELCDLEEGPVNRGGGGSGGGGSGGGGSGGVVCQDWEGVELCW
QGG SEQ ID NO: 8071 hIgG2-Fc-(PA)10 IL-2Rβγc ligand
ERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKG
QPREPQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGAPAPAPAPAPAPAPAPA
PAPAGGWYPCWIARVGELCDLEEGPVNRGGGGSGGGGSGGGGSGGGGSGGVVCQDWEG
VELCWQGG SEQ ID NO: 8072 hIgG2-Fc-(PA)10 IL-2Rβγc ligand
ERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKG
QPREPQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGAPAPAPAPAPAPAPAPA
PAPAGGRYVHDCFIAQVGDLCDLFLHGGGGSGGGGSGGVVCQDWEGVELCWQGG SEQ ID NO: 8073 hIgG2-Fc-(PA)10 IL-2Rβγc ligand
ERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKG
QPREPQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGAPAPAPAPAPAPAPAPA
PAPAGGRYVHDCFIAQVGDLCDLFLHGGGGSGGGGSGGGGSGGVVCQDWEGVELCWQG
G SEQ ID NO: 8074 hIgG2-Fc-(PA)10 IL-2Rβγc ligand
ERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKG
QPREPQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGAPAPAPAPAPAPAPAPA
PAPAGGRYVHDCFIAQVGDLCDLFLHGGGGSGGGGSGGGGSGGGGSGGVVCQDWEGVEL
CWQGG SEQ ID NO: 8075 ZW1 A-(PA)10 IL-2Rβγc ligand
DKTHTCPPCPAPEAAGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALGAPIEKTISKAKG
QPREPQVYVYPPSRDELTKNQVSLTCLVKGFYPSDIAVEWESNGQPENNYKTTPPVLDSDG
SFALVSKLTVDKSRWQQGNVFSCSVMHEALHNHYTQKSLSLSPGAPAPAPAPAPAPAPAPA
PAPAGGLVDCFKVKVGELCDLFGGGGSGGVVCQDWEGVELCWQGG SEQ ID NO: 8076 ZW1_B
DKTHTCPPCPAPEAAGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALGAPIEKTISKAKG
QPREPQVYVLPPSRDELTKNQVSLLCLVKGFYPSDIAVEWESNGQPENNYLTWPPVLDSDG
SFFLYSKLTVDKSRWQQGNVFSCSVMHEALHNHYTQKSLSLSPG SEQ ID NO: 8077 Cys-Knob-(PA)10 IL-2Rβγc ligand
DKTHTCPPCPAPEAAGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALGAPIEKTISKAKG
QPREPQVYTLPPCRDELTKNQVSLWCLVKGFYPSDIAVEWESNGQPENNYKTTPPVLDSDG

TABLE 6-continued

Ligand immunoglobulin constructs.

```
SFFLYSKLTVDKSRWQQGNVFSCSVMHEALHNHYTQKSLSLSPGAPAPAPAPAPAPAPA
PAPAGGLVDCFKVKVGELCDLFGGGGSGGVVCQDWEGVELCWQGG

SEQ ID NO: 8078 Cys-Hole
DKTHTCPPCPAPEAAGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALGAPIEKTISKAKG
QPREPQVCTLPPSRDELTKNQVSLSCAVKGFYPSDIAVEWESNGQPENNYKTTPPVLDSDGS
FFLVSKLTVDKSRWQQGNVFSCSVMHEALHNHYTQKSLSLSPG SEQ ID NO: 8079 ZW1_A-(PA)10 IL-2Rβγc ligand
DKTHTCPPCPAPEAAGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALGAPIEKTISKAKG
QPREPQVYVYPPSRDELTKNQVSLTCLVKGFYPSDIAVEWESNGQPENNYKTTPPVLDSDG
SFALVSKLTVDKSRWQQGNVFSCSVMHEALHNHYTQKSLSLSPGAPAPAPAPAPAPAPA
PAPAGGRYVHDCFIAQVGDLCDLFLHGGGSGGV TABLE 7-continued Components of IL-2Rβγc ligand constructs.

| IL-2Rβγc Ligand Construct | Construct | Linker | IL-2Rβ Ligand | IL-2Rβγc Ligand Linker | IL-2Rβγc Ligand |
|---|---|---|---|---|---|
| SEQ ID NO: 8066 | hIgG2-Fc | (PA)10 (SEQ ID NO: 9428) | SEQ ID NO: 2935 | GGGGS (SEQ ID NO: 9395) | SEQ ID NO: 9340 |
| SEQ ID NO: 8067 | hIgG2-Fc | (PA)10 (SEQ ID NO: 9428) | SEQ ID NO: 2936 | GGGGS (SEQ ID NO: 9395) | SEQ ID NO: 9340 |
| SEQ ID NO: 8068 | hIgG2-Fc | (PA)10 (SEQ ID NO: 9428) | SEQ ID NO: 2937 | GGGGS (SEQ ID NO: 9395) | SEQ ID NO: 9340 |
| SEQ ID NO: 8069 | hIgG2-Fc | (PA)10 (SEQ ID NO: 9428) | SEQ ID NO: 2930 | (GGGGS)2 (SEQ ID NO: 9396) | SEQ ID NO: 9340 |
| SEQ ID NO: 8070 | hIgG2-Fc | (PA)10 (SEQ ID NO: 9428) | SEQ ID NO: 2930 | (GGGGS)3 (SEQ ID NO: 9397) | SEQ ID NO: 9340 |
| SEQ ID NO: 8071 | hIgG2-Fc | (PA)10 (SEQ ID NO: 9428) | SEQ ID NO: 2930 | (GGGGS)4 (SEQ ID NO: 9398) | SEQ ID NO: 9340 |
| SEQ ID NO: 8072 | hIgG2-Fc | (PA)10 (SEQ ID NO: 9428) | SEQ ID NO: 2934 | (GGGGS)2 (SEQ ID NO: 9396) | SEQ ID NO: 9340 |
| SEQ ID NO: 8073 | hIgG2-Fc | (PA)10 (SEQ ID NO: 9428) | SEQ ID NO: 2934 | (GGGGS)3 (SEQ ID NO: 9397) | SEQ ID NO: 9340 |
| SEQ ID NO: 8074 | hIgG2-Fc | (PA)10 (SEQ ID NO: 9428) | SEQ ID NO: 2934 | (GGGGS)4 (SEQ ID NO: 9398) | SEQ ID NO: 9340 |
| SEQ ID NO: 8075 | ZW1_A | (PA)10 (SEQ ID NO: 9428) | SEQ ID NO: 2938 | GGGGS (SEQ ID NO: 9395) | SEQ ID NO: 9340 |
| SEQ ID NO: 8076 | ZW1_B | — | — | — | — |
| SEQ ID NO: 8077 | Cys-Knob | (PA)10 (SEQ ID NO: 9428) | SEQ ID NO: 2934 | GGGGS (SEQ ID NO: 9395) | SEQ ID NO: 9340 |
| SEQ ID NO: 8078 | Cys-Hole | — | — | — | — |
| SEQ ID NO: 8079 | ZW1-A | (PA)10 (SEQ ID NO: 9428) | SEQ ID NO: 2934 | GGGGS (SEQ ID NO: 9395) | SEQ ID NO: 9340 |
| SEQ ID NO: 8080 | Cys-Knob | (PA 10 (SEQ ID NO: 9428) | SEQ ID NO: 2934 | GGGGS (SEQ ID NO: 9395) | SEQ ID NO: 9340 |
| SEQ ID NO: 8081 | ZW1_A | (GS)10 (SEQ ID NO: 9407) | SEQ ID NO: 2939 | GGGGS (SEQ ID NO: 9395) | SEQ ID NO: 9340 |

TABLE 7-continued

Components of IL-2Rβγc ligand constructs.

| IL-2Rβγc Ligand Construct | Construct | Linker | IL-2Rβ Ligand | IL-2Rβγc Ligand Linker | IL-2Rβγc Ligand |
|---|---|---|---|---|---|
| SEQ ID NO: 8082 | Cys-Knob | (GS)10 (SEQ ID NO: 9407) | SEQ ID NO: 2939 | GGGGS (SEQ ID NO: 9395) | SEQ ID NO: 9340 |

An Fc fusion protein can comprise two Fc chains with at least one of the Fc chains comprising a fused IL-2Rβγc ligand and optionally an Fc-linker. The dimeric Fc-fusion proteins can be configured to have one IL-2Rβγc ligand, which can be referred to as monovalent IL-2Rβγc ligand-Fc-fusion, where an IL-2Rβγc ligand is covalently bound to one of the Fc chains and the other Fc chain is not bound to an IL-2Rβγc ligand. In a bivalent IL-2Rβγc ligand Fc-fusion an IL-2Rβγc ligand is fused to each Fc chain.

In addition to homodimeric bivalent IL-2Rβγc ligand Fc fusion proteins, in a monovalent IL-2Rβγc ligand Fc-fusion protein, one Fc chain can be empty and heterodimerization variants can be used to bring the two Fc chains together. These embodiments rely on the use of two different variant Fc sequences, that can self-assemble to form heterodimeric Fc chains and heterodimeric Fe fusion proteins. There are a number of mechanisms that can be used to generate the heterodimers. In addition, these mechanisms can be combined to ensure high heterodimerization. Heterodimerization variants can include steric variants such as knobs and holes or skew variants, charge pairs variants, and pH variants.

IL-2Rβγc ligand constructs provided by the present disclosure include constructs in which one or more IL-2Rβ ligands are bound to a construct partner and independently one or more IL-2Rγc ligands are bound to the construct partner. For example, an IL-2Rβ ligand can be bound to the C-terminus of an Fc fragment or immunoglobulin and an IL-2Rγc ligand can be bound to the N-terminus of an Fc fragment or an immunoglobulin. As another example, an IL-2Rβ ligand can be bound to the C-terminus of one heavy chain of an Fc fragment or immunoglobulin and an IL-2Rγc ligand can be bound to the other heavy chain of the Fc fragment or immunoglobulin.

A construct comprising one or more IL-2Rβ ligands and/or one or more IL-2Rγc ligands can comprise one or more IL-2Rβγc ligands bound to the construct partner. FIGS. 22 and 23 show examples of Fc fragments and immunoglobulins, respectively, in which ligands are bound to the C-terminus and/or to the N-terminus of the construct partner. Each of the ligands can independently be selected from an IL-2Rβγc ligand, an IL-2Rβ ligand, or an IL-2Rγc ligand.

In constructs comprising a protein or synthetic polymer, one or more IL-2Rβ ligands, one or more IL-2Rγc ligands, and/or one or more IL-2Rβγc ligands can be bound to the construct partner. For example, the ligands can be bound to the C-terminus and N-terminus of the protein or to the terminal groups of the polymer, and/or to functionalized side chains.

Each of the one or more IL-2Rβ ligands and one or more IL-2Rγc ligands can independently be bound to a construct partner through a construct linker. The construct linker can be, for example, any of the rigid or flexible linkers disclosed herein, and can be selected to facilitate a desired interaction with IL-2R.

IL-2Rβγc ligand constructs provided by the present disclosure can comprise a construct linker covalently binding an IL-2Rβγc ligand or a tandem IL-2Rβγc ligand to a construct partner including, for example, any of the peptides, polymers, Fc-fragments, immunoglobulin fragments, and antibodies disclosed herein.

A construct linker can be configured to facilitate binding of an IL-2Rβγc ligand to a binding site on IL-2R. A construct linker can be configured to facilitate activation of IL-2R by an IL-2Rβγc ligand.

A construct linker can be a peptidyl construct linker. A peptidyl construct linker can comprise, for example, from 2 to 30 amino acids, from 2 to 25 amino acids, from 2 to 20 amino acids, from 2 to 15 amino acids or from 2 to 10 amino acids. A peptidyl construct linker can comprise, for example, less than 30 amino acids, less than 25 amino acids, less than 20 amino acids, less than 15 amino acids, less than 10 amino acids, or less than 5 amino acids. A peptidyl construct linker can comprise, for example, more than 2 amino acids, more than 4 amino acids, more than 8 amino acids, more than 12 amino acids, or more than 16 amino acids.

A peptidyl construct linker can have a length, for example, from 5 Å to 500 Å, such as from 10 Å to 400 Å, from 50 Å to 300 Å, or from 100 Å to 200 Å. A peptidyl construct linker can have a length, for example, greater than 5 Å, greater than 10 Å, greater than 50 Å, greater than 100 Å, greater than 200 Å, greater than 300 Å, or greater than 400 Å.

A construct linker can be a chemical construct linker. A chemical construct linker can have a length, for example, from 5 Å to 500 Å, such as from 10 Å to 400 Å, from 5 Å to 300 Å, or from 100 Å to 200 Å. A chemical linker can have a length, for example, greater than 5 Å, greater than 10 Å, greater than 50 Å, greater than 100 Å, greater than 200 Å, greater than 300 Å, or greater than 400 Å.

A chemical construct linker can comprise a backbone comprising, for example, from 3 to 100 bonds, from 5 to 90 bonds, from 10 to 80 bonds, or from 20 to 60 bonds. A chemical construct linker can comprise a backbone comprising, for example, greater than 3 bonds, greater than 5 bonds, greater than 10 bonds greater than 20 bonds greater than 50 bonds, or greater than 100 bonds.

Examples of suitable peptidyl construct linkers include peptides having anyone of SEQ ID NOS: 9380-9401 and 9420-9425, where n can be an integer from 1 to 30, such as from 2 to 25, from 2 to 20, from 2 to 16, from 3 to 12, from 4 to 10, or from 6 to 8.

An IL-2Rβγc ligand can be bound to a construct linker through the N-terminus or through the C-terminus of the IL-2Rβγc ligand.

Examples of IL-2Rβγc ligand constructs having different linker configurations are shown in FIGS. 19A-19C.

In IL-2Rβγc ligand constructs having more than one IL-2Rβγc ligand, each of the IL-2Rβγc ligands can be bound to the construct partner through an independent construct.

Each of the construct linkers can be the same or at least one of the construct linkers can be different. Each of the more than one IL-2Rβγc ligands can be bound to a respective construct partner through the N-terminus or through the C-terminus of the IL-2Rβγc ligand.

A construct linker can comprise a cleavable construct linker. A cleavable construct linker can be cleaved in vivo, for example, in the presence of a certain pH, enzymatically, or by application of energy such as by application of electromagnetic radiation including ultraviolet light or infrared irradiation.

An IL-2Rβγc ligand construct can comprise one or more IL-2Rβγc ligands bound to a checkpoint inhibitor, such as a PD-1 checkpoint inhibitor including, for example, an antibody checkpoint inhibitor such as pembrolizumab and cemiplimab.

In an IL-2Rβγc checkpoint inhibitor construct, the one or more IL-2Rβγc ligands can have the amino acid sequence of any one of SEQ ID NOS: 1263-1270, or an amino acid sequence having greater than 60%, greater than 70%, greater than 80%, greater than 85%, greater than 90%, or greater than 95% amino acid sequence similarity to any one of SEQ ID NOS: 1263-1270.

In IL-2Rβγc checkpoint inhibitor antibody constructs the one or more IL-2Rβγc ligands can have an amino acid sequence of any one of SEQ ID NOS: 1263-1270 or an IL-2Rβγc ligand having an amino acid sequence similarity to any one of SEQ ID NOS: 1263-1270 bound to the C-terminus of one heavy chain, the C-terminus of both heavy chains, the N-terminus of one heavy chain, the N-terminus of both heavy chains, the N-terminus of on light chain, the N-terminus of both light chains, or a combination of any of the foregoing. Each of the one or more IL-2Rβγc ligands can independently be bound to the checkpoint inhibitor antibody through a construct linker, which can comprise, for example, from 1 to 50 amino acids.

The N-terminus of the IL-2Rβγc ligand can be bound to the checkpoint inhibitor antibody through the construct linker.

An IL-2Rβγc ligand construct can be a pembrolizumab/IL-2Rβγc fusion protein where the light chain has the amino acid sequence of SEQ ID NO: 1218 (FP7), or an amino acid sequence having greater than 60%, greater than 70%, greater than 80%, greater than 85%, greater than 90%, or greater than 95% amino acid sequence similarity to SEQ ID NO: 1218 (FP7); and the heavy chain has the amino acid sequence of SEQ ID NO: 1219 (FP8)), or an amino acid sequence having greater than 60%, greater than 70%, greater than 80%, greater than 85%, greater than 90%, or greater than 95% amino acid sequence similarity to SEQ ID NO: 1219 (FP8).

A pembrolizumab/IL-2Rβγc fusion protein can comprise two pembrolizumab heavy chains and two pembrolizumab light chains, wherein an IL-2Rβγc ligand having an amino acid sequence of any one of SEQ ID NOS: 1263-1270 or an amino acid sequence having greater than 60%, greater than 70%, greater than 80%, greater than 85%, greater than 90%, or greater than 95% amino acid sequence similarity to SEQ ID NOS: 1263-1270 is bound to the C-terminus of one heavy chain, the C-terminus of both heavy chains, the N-terminus of one heavy chain, the N-terminus of both heavy chains, the N-terminus of one light chain, the N-terminus of both light chains, or a combination of any of the foregoing. Each of the one or more IL-2Rβγc ligands can independently be bound to the pembrolizumab antibody through a construct linker, which can comprise, for example, from 1 to 50 amino acids.

The N-terminus of the IL-2Rβγc ligand can be bound to pembrolizumab through the construct linker.

An IL-2Rβγc ligand construct can be a cemiplimab/IL-2Rβγc fusion protein where the light chain has the amino acid sequence of SEQ ID NO: 1220 (FP9), or an amino acid sequence having greater than 60%, greater than 70%, greater than 80%, greater than 85%, greater than 90%, or greater than 95% amino acid sequence similarity to SEQ ID NO: 1220 (FP9); and the heavy chain has the amino acid sequence of SEQ ID NO: 1221 (FP10)), or an amino acid sequence having greater than 60%, greater than 70%, greater than 80%, greater than 85%, greater than 90%, or greater than 95% amino acid sequence similarity to SEQ ID NO: 1221 (FP10).

A cemiplimab/IL-2Rβγc fusion protein can comprise two cemiplimab heavy chains and two cemiplimab light chains, wherein an IL-2Rβγc ligand having an amino acid sequence of any one of SEQ ID NOS: 1263-1270, or an amino acid sequence having greater than 60%, greater than 70%, greater than 80%, greater than 85%, greater than 90%, or greater than 95% amino acid sequence similarity to any one of SEQ ID NOS: 1263-1270 is bound to the C-terminus of one heavy chain, the C-terminus of both heavy chains, the N-terminus of one heavy chain, the N-terminus of both heavy chains, the N-terminus of one light chain, the N-terminus of both light chains, or a combination of any of the foregoing. Each of the one or more IL-2Rβγc ligands can independently be bound to the cemiplimab antibody through a construct linker, which can comprise, for example, from 1 to 50 amino acids.

The N-terminus of the IL-2Rβγc ligand can be bound to cemiplimab through the construct linker.

An IL-2Rβγc ligand construct can be a hIgG2/IL-2Rβγc fusion protein where hIgG2 has the amino acid sequence of SEQ ID NO: 1268 or an amino acid sequence greater than 60%, greater than 70%, greater than 80%, greater than 85%, greater than 90%, or greater than 95% amino acid sequence similarity to SEQ ID NO: 1268 and one or more IL-2Rβγc ligands having an amino acid sequence of any one of SEQ ID NOS: 1263-1270 or an amino acid sequence greater than 60%, greater than 70%, greater than 80%, greater than 85%, greater than 90%, or greater than 95% amino acid sequence similarity to any one of SEQ ID NOS: 1263-1270 is bound to one C-terminus of hIgG2, both C-termini of hIgG2, one N-terminus of hIgG2, both N-termini of hIgG2, or a combination of any of the foregoing. Each of the one or more IL-2Rβγc ligands can independently be bound to IgG2 through a construct linker, which can comprise, for example, from 1 to 50 amino acids. The IgG fusion partner can be hIgG1 or hIgG4 and the one or more IL-2Rβγc ligands can be bound to the hIgG1 or hIgG4 fusion partner as described for hIgG2.

The N-terminus of the IL-2Rβγc ligand can be bound to hIgG2 through the construct linker.

An IL-2Rβγc ligand/immunoglobulin fusion protein can comprise one or more IL-2Rβγc ligands bound to an immunoglobulin such as hIgG1, hIgG2, hIgG3, or hIgG4. Examples of IL-2Rβγc ligand/immunoglobulin constructs are shown in FIGS. 23A-23F, where the immunoglobulin comprises heavy chains 231 and light chains 232, and IL-2Rβγc ligands 233 bound to either the C-terminus and/or N-terminus of the heavy chains 231 and/or light chains 232.

An IL-2Rβγc ligand construct can comprise one or more IL-2Rβγc ligands bound to an immunoglobulin Fc-fragment. The one or more IL-2Rβγc ligands can have the amino acid sequence of any one of SEQ ID NOS: 1263-1270, or an amino acid sequence having greater than 60%, greater than 70%, greater than 80%, greater than 85%, greater than 90%, or greater than 95% amino acid sequence similarity to any one of SEQ ID NOS: 1263-1270. The IL-2Rβγc ligands can be bound to the C-terminus and/or to the N-terminus and to one or both of the Fc-chains of the Fc fragment. As shown in FIGS. 22A-22F, an IL-2Rβγc ligand 223 can be bound to one or both Fc-chains 221 and 222.

The Fc-fragment can be derived, for example, from any suitable immunoglobulin such as hIgG1, hIgG2, hIgG3, or hIgG4.

The N-terminus of the IL-2Rβγc ligand can be bound to an Fc-fragment through the construct linker. The construct linker can be selected, for example, from a construct linker having an amino acid sequence of any one of SEQ ID NOS: 9380-9407. The construct linker can be selected, for example, from a peptidyl construct linker having an amino acid sequence of any one of SEQ ID NOS: 9420-9428. A construct linker can comprise, for example, from 1 to 100 amino acids such as from 1 to 50, from 1 to 20, from 1 to 10 or from 1 to 5 amino acids where each amino acid is independently selected from S and G. A construct linker can comprise, for example, from 1 to 100 amino acids such as from 1 to 50, from 1 to 20, from 1 to 10 or from 1 to 5 amino acids where each amino acid is independently selected from proline, alanine, lysine, and glutamic acid. A construct linker can comprise, for example, $(PA)_n$ (SEQ ID NO: 9421) where n can be, for example, an integer from 1 to 20. Each construct linker can be selected such that an IL-2Rβγc ligand to which it is bound is an IL-2R agonist. The linker can be, for example, a peptidyl linker selected from any one of SEQ ID NOS: 9384, 9389, and 9394-9398.

Functionally, an IL-2Rβγc binding compound provided by the present disclosure can be, for example, a full IL-2R agonist, a partial IL-2R agonist a diagnostic reagent, an imaging reagent, a targeting compound, a cytotoxic compound, and/or a compound exhibiting dual pharmacology.

An IL-2Rβγc binding compound provided by the present disclosure can be attached to one or more moieties that impart a property to the compound that enhances therapeutic efficacy. Examples of properties include potency, aqueous solubility, polarity, lipophilicity, pharmacokinetics, targeting, bioavailability, pH-dependent binding, bioactivity, pharmacodynamics, cellular activity, metabolism, efficacy, reversible incapacitation (caging), selectivity, or a combination of any of the foregoing.

A cell-specific targeting moiety can comprise a moiety that has an affinity for a component on the surface of a cell such as a receptor, a protein, or an epitope. A targeting moiety can comprise, for example, a ligand or an antibody having an affinity to a cell surface component.

A targeting moiety can direct and concentrate compounds comprising an IL-2Rβγc binding compound at the cells, population of cells, or tissue targeted by the targeting moiety.

A targeting moiety can enhance the potency of IL-2R agonism or IL-2R antagonism for the cells or population of cells being targeted.

A targeting moiety can provide a differential response to IL-2R agonism or to IL-2R antagonism between the cells being targeted and the cells not being targeted by the targeting moiety.

A targeting moiety can provide a differential response to IL-2R agonism or IL-2R antagonism between cells having a high expression level of the targeted component and cells having a lower expression level of the targeted component.

An IL-2Rβγc binding compound can further comprise a bioactive moiety or a bioactive molecule. An IL-2Rβγc compound can be used to deliver the bioactive moiety or bioactive molecule to cells, to a population of cells, or to a tissue expressing the IL-2Rβ subunit and the Rγc subunit.

The bioactive moiety or molecule can be non-cleavable and capable of exerting a biological activity when bound to an IL-2Rβγc binding compound.

The bioactive moiety or molecule can be cleavable. The moiety can be cleavable by any suitable mechanism such as by pH, enzymatic, thermal, and/or electromagnetic mechanisms. Electromagnetic mechanisms include, for example, exposing the compounds to infrared, visible, or ultraviolet radiation, where the bioactive moiety is attached to the compounds comprising a ligand through a photolabile moiety capable of being cleaved by the radiation.

The bioactive molecule can be non-cleavable but otherwise activatable, such as for example, activatable by exposure to electromagnetic radiation.

Ligands can be selected to have enhanced binding to the IL-2Rβ and/or Rγc subunit at a certain pH. For example, a pH-selective ligand can have a greater binding affinity to the IL-2Rβ and/or Rye subunit at low pH commensurate with that of a solid tumor microenvironment. IL-2Rβγc binding compounds comprising low-pH selective ligands can be used to preferentially activate cells in low pH environments expressing the IL-2Rβ subunit and the Rγc subunit compared to cells in normal pH environments associated with healthy tissue.

Thus, A IL-2Rβγc binding compounds comprising selective IL-2Rβ and/or Rγc ligands such as pH-selective IL-2Rβ and/or Rγc ligands can be used with other pH-selective bioactive moieties and molecules.

A bioactive moiety or bioactive molecule can itself be selective for a particular cell population. For example, a bioactive moiety or bioactive molecule can exhibit a greater or lesser binding affinity, potency, and/or activity at the cell being targeted by a selective ligand. For example, the bioactive moiety or molecule can exhibit greater bioactivity in a low pH tumor microenvironment when targeted by a pH-selective ligand. In this example, the bioactive moiety is directed to cells located in the low-pH tumor microenvironment that express the IL-2Rβ subunit by the pH-selective ligand. Thus, the activity of the pH-selective bioactive moiety is enhanced in the low-pH tumor microenvironment.

An IL-2Rβγc binding compound can further comprise a cytotoxic moiety or cytotoxic molecule. Such compounds can be used to deliver a cytotoxic moiety or compound to a cell expressing the IL-2Rβγc subunit. The cytotoxic moiety or molecule can exert cytotoxicity when bound to the compound or can be cleavable and the moiety or molecule can be cytotoxic when released from the compound; or the cytotoxic moiety can be activated by electromagnetic radiation.

The cytotoxic moiety or molecule can be used to deplete cells expressing the IL-2Rβ subunit being targeted.

Cytotoxic an IL-2Rβγc binding compounds can have more than one Il-2Rβγc ligands and thereby can exhibit a higher affinity and/or selectivity to cells, populations of cells, and tissue that highly expresses the IL-2Rβ subunits compared to cells having a lower expression level of the IL-2Rβ subunit.

Cytotoxic IL-2Rβγc binding compounds can further include a cell surface targeting component. Such cytotoxic compounds can exhibit enhanced efficacy to cells, populations of cells, and tissue expressing the IL-2Rβ subunit and the surface target component.

Examples of suitable cytotoxic molecules include anti-microtubule agents, alkylating agents, and DNA minor groove binding agents.

An IL-2Rβγc binding compound can comprise a moiety having an additional pharmacological activity other than that mediated by activation of the IL-2 receptor. The pharmacological activity can be an activity that has a therapeutic efficacy that is synergistic with that of IL-2R agonist or antagonist activity or the pharmacological activity can be an activity that has a therapeutic efficacy that is not synergistic with that of the IL-2R agonist or antagonist activity. Examples of suitable pharmacological moieties include antibodies and antibody fragments that are inhibitors of checkpoint molecules, pro-apoptotic and anti-apoptotic molecules, cytotoxic molecules, agonists of chemokine, antagonists of chemokine, cytokine, growth factor and other cell surface receptors, and ligands and inhibitors of cell surface adhesion molecules such as integrins.

One or more ligands provided by the present disclosure can be bound to a molecule comprising a targeting moiety that confers the ability to target the one or more IL-2Rβγc ligands to specific tissues or cells in a patient. A targeting moiety can have an affinity for a cell-surface protein or receptor expressed on the surface of a target tissue or target cell, and thereby can direct a dual ligand to the target tissue or cell. Examples of targeting moieties include antigen binding moieties including antibodies and fragments thereof specific for cell surface proteins, ligands, biological receptors, and antigens.

An antibody can bind to an antigen expressed on the surface of the target cell type. The antibody may not have any useful or known useful pharmacologic function but serves to direct an IL-2Rβγc binding construct to preferentially target a cell type or tissue compared to cell types or tissues not expressing the targeted antigen or having an expression level of the targeted antigen less than that of the targeted cell type or tissue. An antibody can have a useful pharmacological function when bound to a cell surface antigen. These constructs are referred to as dual pharmacology IL-2Rβγc binding constructs.

An IL-2Rβγc binding compound can include, for example, a tumor-targeting moiety such as, for example, a tumor-specific antibody, a tumor-specific antibody fragment, a tumor-specific protein, a tumor-specific peptide, a non-peptidyl tumor cell ligand, or a combination of any of the foregoing.

An IL-2Rβγc binding compound can include an immune cell-targeting moiety such as, for example, an immune cell-specific antibody, an immune cell-specific antibody fragment, an immune cell-specific protein, an immune cell-specific peptide, a non-peptidyl immune cell-ligand, or a combination of any of the foregoing.

One or more IL-2Rβγc ligands can be bound to a molecule comprising a targeting moiety that confers the ability to target the one or more IL-2Rβγc ligands to specific tissues or cells in a patient. A targeting moiety can have an affinity for a cell-surface protein or receptor expressed on the surface of a target tissue or target cell, and thereby can direct an IL-2Rβγc ligand to the target tissue or cell. Examples of targeting moieties include antigen binding moieties including antibodies and fragments thereof specific for cell surface proteins, ligands, biological receptors, and antigens.

An antibody can bind to an antigen expressed on the surface of the target cell type. The antibody may not have any useful or known useful pharmacologic function but serves to direct an IL-2Rβγc ligand construct to preferentially target a cell type or tissue compared to cell types or tissues not expressing the targeted antigen or having an expression level of the targeted antigen less than that of the targeted cell type or tissue. An antibody can have a useful pharmacological function when bound to a cell surface antigen. These constructs are referred to as dual pharmacology IL-2Rβγc ligand constructs.

An IL-2Rβγc ligand fusion protein can comprise one or more antigen binding moieties. The two more antigen binding moieties can be directed to the same antigen or to different antigens.

A targeting moiety can be an antigen binding moiety and the IL-2Rβγc fusion protein can be an immunoconjugate. The immunoconjugate can comprise one or more antigen binding moieties capable of binding to an antigen expressed on a cell surface, on the surface of virus-infected cells on the surfaces of diseased cells in the blood serum, and/or in the extracellular matrix.

An antigen binding moiety can comprise an antibody or an antibody fragment. The antigen binding moiety can be an immunoglobulin molecule such as, for example, an IgG class immunoglobulin, including an IgG1, IgG2, or IgG4 isotype. An IL-2Rβγc ligand can be bound to one or both of the heavy chains such as at the C-terminus of the CH3 domain. An antigen binding moiety can be a Fab molecule, an scFv molecule, or a peptide.

An antigen binding moiety can be directed to any specific antigen such as, for example, an antigen expressed on the surface of a tumor cell or in a tumor cell environment, an antigen expressed on an immune cell, an antigen expressed on the surface of a cell expressing predominantly the IL-2Rβ and IL-2Rγc subunits of IL-2R such as CD4+ T-cells, CD8+ T-cells, Tregs, or NK cells.

Examples of suitable antigen targets expressed on tumor cells include fibroblast activation protein (FAP), the A1 domain of tenascin-C (TNC A1), the A2 domain of tenascin-C (TNC A2), the extradomain B of fibronectin (EDB), carcinoembryonic antigen (CEA), and the melanoma-associated chondroitin sulfate proteoglycan (MCSP).

Other examples of suitable tumor antigens that can be used for targeting include MAGE, MART-1/Melan-A, gplOO, Dipeptidyl peptidase IV (DPPIV), adenosine deaminase-binding protein (ADAbp), cyclophilin b, Colorectal associated antigen (CRC)-0017-A/GA733, Carcinoembryonic Antigen (CEA) and its immunogenic epitopes CAP-1 and CAP-2, etv6, amll, Prostate Specific Antigen (PSA) and its immunogenic epitopes PSA-1, PSA-2, and PSA-3, prostate-specific membrane antigen (PSMA), T-cell receptor/CD3-zeta chain, MAGE-family of tumor antigens (e.g., MAGE-A1, MAGE-A2, MAGE-A3, MAGE-A4, MAGE-A5, MAGE-A6, MAGE-A7, MAGE-A8, MAGE-A9, MAGE-AlO, MAGE-All, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-C5), GAGE-family of tumor antigens such as GAGE-I, GAGE-2, GAGE-3, GAGE-4, GAGE-5, GAGE-6, GAGE-7, GAGE-8, GAGE-9, BAGE, RAGE, LAGE-I, NAG, GnT-V, MUM-1, CDK4, tyrosinase, p53, MUC family, HER2/neu, p21ras, RCAS1, a-fetoprotein, E-cadherin, a-catenin, -catenin and y-catenin, p120ctn, gplOO Pmel117, PRAME, NY-ES0-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, lmp-1, PIA, EBY-encoded nuclear antigen (EBNA)-1, brain glycogen phosphorylase, SSX-1, SSX-2 (HOM-MEL-40), SSX-1, SSX-4, SSX-5, SCP-1 and CT-7, and c-erbB-2.

Examples of viral antigens include influenza virus hemagglutinin, Epstein-Barr virus LMP-1, hepatitis C virus E2 glycoprotein, HIV gp160, and HIV gp120.

Examples of ECM antigens include syndecan, heparanase, integrins, osteopontin, link, cadherins, laminin, laminin type EGF, lectin, fibronectin, notch, tenascin, and matrixin.

Targeted IL-2Rβγc ligand fusion proteins can be configured to bind, for example, to a cell surface antigen selected from FAP, Her2, EGFR, IGF-1R, CD2 (T-cell surface antigen), CD3 (heteromultimer associated with the TCR), CD22 (B-cell receptor), CD23 (low affinity IgE receptor), CD30 (cytokine receptor), CD33 (myeloid cell surface antigen), CD40 (tumor necrosis factor receptor), IL-6R (IL6 receptor), CD20, MCSP, and PDGFR (platelet-derived growth factor receptor).

A targeted IL-2Rβγc ligand construct can comprise an antigen binding moiety capable of binding to an antigen or to a receptor expressed on the surface of a cell by a cell that also expresses IL-2R. Examples of cells expressing IL-2R include, for example, Treg cells, NK cells, CD8+ T-cells, CD4+ T-cells and activated T-cells.

A targeted IL-2Rβγc ligand construct can comprise an antigen binding moiety capable of binding to an antigen or a receptor expressed by a cell that expresses the IL-2Rβ and IL-2Rγc subunits of IL-2R. Examples of cells expressing the IL-2Rβ and IL-2Rγc subunits of IL-2R include, for example, NK cells, CD4+ T-cells, CD8+ T-cells cells, and activated T-cells.

Examples of antigens expressed on the surface of naïve CD4+ T-cells include CD4+, CD45RA+, CD45RO−, CCR7+, and CD25.

Examples of antigens expressed on the surface of CD8+ T-cells include NKG2D, CD8+, CD45RA+, CD450+, CCR7+, and CD28+.

Examples of antigens expressed on the surface of CD4+ T-cells include Th1 cell markers such as CD4+, CXCR3+, CCR5+, and IL12Rβ 2+; Th2 cell markers such as CD4+, CCR4+, and IL12Rβ 2+; Th9 cell markers such as CD4+, CCR3+, and CCR5+; Th17 cell markers such as CD4+, CCR6+, CCR4+, and NK1.1+; Th22 cell markers such as CD4+, CCR10+, CCR4+, and CCR6+; Treg cell markers such as CD4+, CD127+, CD24+, and CTLA-4+; and Tfh cell markers such as CD4+, CXCR5+, CD40L+, and ICOS+.

Examples of antigens expressed on the surface of cytotoxic CD8+ T cell include CD8+ and CCR7−.

Examples of memory T-cell antigens include CCR5, CCR7, CD11a, CD27, CD28, CD45RA, CD45RO, CD57, and/CD62.

Examples of naïve T-cell antigens include CD45RA, CCR7, CD62L, CD127, and CD132.

Examples of antigens expressed on the surface of NK cells include TRAIL, CD16, NKp30ab, NKG2C, NKG2D, 2B4, DNAM-1, NKH2A, KIRs, CD137, OX40, CD27, CD16, CD56, CD57, and CD 27.

A targeted IL-2Rβγc ligand construct can comprise an antigen binding moiety capable of binding to an antigen or receptor expressed on the surface of cells having a role in regulating the immune response.

Examples of antigens expressed by cells associated with regulating the immune response include PD-1, CTLA-4, CD20, and CD30.

A targeted IL-2Rβγc ligand construct can comprise an antigen binding moiety capable of binding to an antigen or receptor expressed on the surface of Treg cells such as CD25. For example, a Treg cell-targeted construct can comprise an IL-2Rβγc ligand/daclizumab antibody fusion.

A dual pharmacology IL-2Rβγc ligand construct provided by the present disclosure can comprise an IL-2Rβγc ligand provided by the present disclosure and a pharmacological moiety. A pharmacological moiety can exert a therapeutic effect on cells expressing IL-2R or on cells other than those expressing IL-2R. One or more IL-2Rβγc ligands can be linked to a biological agent including therapeutic compounds such as, for example, antineoplastic agents, antimicrobial agents, hormones, immunomodulators, and anti-inflammatory agents.

A dual pharmacology IL-2Rβγc ligand construct can comprise, for example, a protein such as an antibody. An antibody can be an IgA isotype, IgD isotype, IgE isotype, IgG isotype, or IgM isotype. A dual pharmacology IL-2Rβγc ligand construct can comprise an IL-2Rβγc ligand coupled to a pharmacologically active antibody through a linker. The linker can be a naturally occurring molecule or a synthetic molecule.

A dual pharmacology IL-2Rβγc ligand construct can comprise an antibody having an antigen binding moiety and one or more IL-2Rβγc ligands bound to the Fc chain through an Fc linker.

An antibody can comprise an antibody directed to a cell-specific antigen. Examples of antibodies directed to cell-specific antigens include alemtuzumab (CD52 antigen), trastuzumab (Her2 protein), ibritumomab tiuxetan (CD20 antigen), brentuximab vedotin (CD30 antigen), ado-trastuzumab emtansine (Her2 protein), blinatumomab (CD19 protein and CD3 protein).

A dual pharmacology IL-2Rβγc ligand construct can comprise a moiety known to be useful in treating cancer. Examples of monoclonal antibodies known to be useful in treating cancer include alemtuzmab, atezolizumab, avelumab, bevacizumab, brentuximab, cemiplimab cetuximab, trastuzumab, denosumab, rituximab, ipilimumab, nivolumab, obinutuzumab, ofatumumab, panitumumab, pembrolizumab, pertuzumab, rituximab, and trastuzumab.

A dual pharmacology IL-2Rβγc ligand construct can comprise a moiety known to be a checkpoint inhibitor such as CTLA-4 inhibitors, PD-1 inhibitors, PD-L1, and PD-L2 inhibitors.

Examples of suitable PD-1 inhibitors include nivolumab, cemiplimab, and pembrolizumab; examples of CTLA-4 inhibitors include ipilimumab; and examples of PD-L1 inhibitors include atezolizumab and durvalumab.

Examples of monoclonal antibodies useful in treating autoimmune and inflammatory diseases include abciximab, adalimumab, alefacept, alemtuzumab, basiliximab, belimumab, bezlotuxumab, canakinumab, certolizumab, daclizumab, denosumab, efalizumab, golimumab, inflectra, ipilimumab, ixekizumab, natlizumab, nivolumab, olaratumab, amalizumab, palivizumab, panitumumab, pembrolizumab, rituximab, tocilizumab, trastuzumab, secukinumab, and ustekinumab.

A dual pharmacology IL-2Rβγc ligand antibody construct can comprise an antibody to a checkpoint inhibitor. Antibodies to checkpoint inhibitors include CTLA-4 blockade blocking antibodies, PD-1 inhibitors such as nivolumab, pembrolizumab, and spartalzumab; PD-L1 inhibitors such as alezolizumab; and other antibodies targeting intrinsic checkpoint blockades such as CISH.

Suitable FDA-approved antibody checkpoint inhibitors include ipilimmab (CTLA-4), nivoliuab (PD-1), pembrolizumab (PD-1), alezolzumab (PD-1), avelumab (PD-1), durvalumab (PD-1), and cemiplimab (PD-1).

A dual pharmacology IL-2Rβγc ligand construct can comprise a cytokine fusion. An IL-2Rβγc ligand cytokine construct can comprise one or more IL-2Rβγc ligands and one or more cytokines bound to a naturally occurring or synthetic molecule. For examples, one or more IL-2Rβγc ligands and one or more cytokines can be bound to a polypeptide or to a protein such as an IgG or an Fc-fragment. A cytokine can be selected from, for example, an interleukin, a chemokine, a colony-stimulating factor, an interferon, a transforming growth factor, and a tumor necrosis factor.

An IL-2Rβγc binding construct provided by the present disclosure can comprise a virology construct. An IL-2Rβγc binding virology construct can comprise a ligand provided by the present disclosure to protein expressed on the surface of a virus, an antigen expressed on the surface of a cell targeted by the virus, a cell surface antigen targeted by the virus, or a virus-like particle, or a vaccine.

Certain IL-2Rβγc ligands and IL-2Rβγc ligand constructs provided by the present disclosure can be synthesized using recombinant DNA technology.

Certain IL-2Rβγc ligands and IL-2Rβγc ligand constructs provided by the present disclosure can be synthesized using synthetic organic chemistry methods.

IL-2Rβγc ligands and IL-2Rβγc ligand constructs provided by the present disclosure are agonists of IL-2R.

An IL-2Rβγc ligand and IL-2Rβγc ligand construct can bind to the IL-2Rβ subunit and/or to the IL-2Rγc subunit of IL-2R and can activate IL-2R. The binding affinity ($IC_{50}$) of an IL-2Rβγc ligand or IL-2Rβγc ligand construct to the IL-2Rβ subunit and/or to the IL-2Rγc subunit can independently be, for example, less than 100 μM, less than 10 μM, less than 1 μM, less than 100 nM, less than 10 nM, or less than 1 nM.

The binding affinity ($IC_{50}$) of an IL-2Rβγc ligand or IL-2Rβγc ligand construct to the IL-2Rβ subunit and/or to the IL-2Rγc subunit can be, for example, less than 100 μM, less than 10 μM, less than 1 μM, less than 100 nM, less than 10 nM, or less than 1 nM. An IL-2Rβγc ligand or IL-2Rβγc ligand construct can bind to the IL-2Rβ subunit and/or to the IL-2Rγc subunit either competitively or non-competitively with IL-2.

An IL-2Rβγc ligand or IL-2Rβγc ligand construct can be configured to more potently activate cells expressing the IL-2Rβ subunit and the IL-2Rγc subunit, thereby facilitating the ability to differentially activate IL-2R expressed on the surface of different cell types by controlling a dose of an IL-2Rβγc ligand agonist or IL-2Rβγc ligand construct agonist. For example, when incubated with an IL-2Rβγc ligand or an IL-2Rβγc ligand construct, primary human peripheral blood mononuclear cells (PBMC) expressing the IL-2Rβγc subunit phosphorylate signal transducer and activator of transcription 5 (STAT5).

The $EC_{50}$ for STAT5 phosphorylation in TF-1β or NK-92 cells induced by an IL-2Rβγc ligand or an IL-2Rβγc ligand construct can be, for example, less than 100 μM, less than 10 μM, less than 1 μM, less than 100 nM, less than 10 nM, or less than 1 nM.

The $EC_{50}$ for STAT5 phosphorylation in TF-1β or NK-92 cells induced by an IL-2Rβγc ligand or an IL-2Rβγc ligand construct can be, for example, within a range from 1 μM to 100 μm, from 10 μM to 10 μm, or from 100 μM to 1 μm.

IL-2Rβγc ligands and IL-2Rβγc ligand constructs provided by the present disclosure can active the STAT5 phosphorylation pathway, the AKT phosphorylation pathway, and the ERK1/2 phosphorylation pathway in NK-92 cells.

An IL-2Rβγc ligand or IL-2Rβγc ligand construct can partially activate IL-2R. Partial activation refers to a level of activation, that is, for example, less than 75% of maximum activation, less than 50%, less than 25%, less than 10%, or less than 1% of the maximum activation. Maximum activation ($E_{max}$) of IL-2R refers to the amplitude of cellular signal (activation) achievable at high agonist concentration such as a high concentration of IL-2. Partial IL-2R agonists can be effective in modulating the levels of response of IL-2R to activation of the IL-2Rβ and IL-2Rγc subunits among different cell types expressing IL-2R. For example, different cell types are known to vary in expression levels of each of the IL-2R subunits, IL-2Rα, IL-2Rβ, and IL-2Rγc, and to exhibit different sensitivities to IL-2R agonists.

An IL-2Rβγc ligand or IL-2Rβγc ligand construct can comprise modified IL-2Rβ ligands and/or IL-2Rγc ligands. Modified IL-2Rβ and IL-2Rγc ligands can be selected or designed to bind and activate IL-2R, but with low or modest affinity and potency to IL-2R. Such IL-2Rβγc ligands and IL-2Rβγc ligand constructs can have greater differential sensitivity for IL-2R activation between cells that highly express IL-2Rα and cells having a low level of IL-2Rα expression; for example, between Tregs that have a high expression of IL-2Rα and Teff cells that have a low expression level of IL-2Rα.

IL-2Rβγc ligands and IL-2Rβγc ligand constructs provided by the present disclosure can act as full IL-2R agonists, partial IL-2R agonists, biased IL-2R agonists, or pH-biased IL-2R agonists.

As shown in Example 8, in NK-92 cells, the IL-2Rβγc ligand (BGL21) acts as a full agonist comparable to IL-2 with respect to STAT5 phosphorylation, AKT phosphorylation and ERK1/2 phosphorylation in NK-92 cells.

As shown in Examples 3-6 and corresponding FIGS. 2-5B, other IL-2Rβγc ligands provided by the present disclosure exhibit a STAT5 phosphorylation activity in TF-1β cells that is less than that of IL-2Rβγc ligand (BGL21) and can be considered partial agonists with respect to the STAT5 phosphorylation in TF-1β cells.

As shown in Example 9, with respect to STAT5 phosphorylation in resting CD8 T-cells, resting Treg cells and resting CD4 T-cells, IL-2Rβγc ligand (BGL21) exhibits non-selective agonist activity of around 1E-9 ($EC_{50}$) across the different cell types. In contrast, the $EC_{50}$ for IL-2 varies by about two (2) orders of magnitude and exhibits a high selectivity for STAT5 phosphorylation in resting Treg cells.

Similar effects are observed for IL-2Rβγc ligand constructs where agonist activity as determined by STAT5 phosphorylation in TF-1β cells was modified depending on the IL-2Rβγc ligand, the construct linker, the construct partner, and the binding location on the construct partner.

IL-2Rβγc ligands and IL-2Rβγc ligand constructs provided by the present disclosure can act as IL-2R antagonist. An IL-2Rβγc ligand antagonist and IL-2Rβγc ligand construct antagonist provided by the present disclosure can bind to IL-2R with an $IC_{50}$, for example, of less than 100 μM, less than 10 μM, less than 1 μM, less than 0.1 μM, or less than 0.01 μM and exhibits no detectable functional activity as determined, for example, using any of the functional assays disclosed in the examples such as the STAT5 phosphorylation assay.

IL-2Rβγc binding compounds provided by the present disclosure can be useful when combined with certain vaccines, including cancer neo-antigen vaccines. Mutations in tumor DNA produces new protein sequences that are foreign to the body. Vaccines can be designed to specifically activate a patient's immune system with respect to tumor-specific neoantigens. When administered in combination with a neo-antigen vaccine, IL-2Rβγc binding compounds provided by the present disclosure can expand and proliferate neo-antigen-specific T-cells in the tumor microenvironment and thereby drive maximal expansion of vaccine-induced neoantigen-specific T-cells for the treatment of cancer.

For example, bempegaldesleukin (NKTR-214), reported to be a biased IL-2Rβγc agonist, was combined with neoantigen vaccine VB10.NEO in a preclinical tumor model. Synergistic effects on neoantigen-specific T-cell responses were observed. The synergistic effect was also observed in both CD4 and CD8 T-cells with the most pronounced effects on CD8 T-cells. The neo-antigen vaccine VB10.NEO in combination with NKTR-214 and anti-PD-1 induced rapid and durable tumor regression of small tumors and long-lasting stabilization of large tumors. The combination of NKTR-214 and neo-antigen vaccine VB10.NEO is currently being studied in a human trial.

As another example, a complex of an IL-15 mutant and an Fc-fusion of the IL-15Rα subunit (ALT-803) of IL-15R, which is reported to be an IL-2Rβγ agonist, was co-administered intravascularly with Bacillus Calmette-Guérin (BCG), an immune stimulant, and a vaccine for tuberculosis, in a carcinogen-induced rat non-muscle invasive bladder cancer (NMIBC) model. As a single treatment agent, ALT-803 reduced tumor burden by 35% compared to control whereas BCG alone only reduced the tumor burden by 15%. The combination of ALT-803 and BCG reduced tumor burden by 46% compared to control. The combination is currently being studied in human clinical trials.

Thus, IL-2Rβγc ligands and IL-2Rβγc constructs provided by the present disclosure can be used as adjuvants. An adjuvant refers to a compound that enhances the efficacy of a vaccine without directly participating in the protective immunity. For example, an IL-2Rβγc binding compound provided by the present disclosure can be used in conjunction with a cancer vaccine.

IL-2Rβγc ligands and IL-2Rβγc ligand constructs provided by the present disclosure can be useful for cell therapy when engineered to be expressed on the membrane surface of cells that also express the IL-2Rβγc subunits. Adoptive immunotherapy using NK cells or using re-targeted chimeric antigen receptor (CAR) T-cells is currently being studied as a treatment for neoplasms and viral infections. One challenge with these cell therapies is the suboptimal sustained survival of the infused cells.

DNA encoding an IL-2Rβγc ligand fused to a membrane protein in such a way that the IL-2Rβγc ligand is expressed on the extracellular surface of a cell can be constructed using standard techniques. When the fusion protein comprising the IL-2Rβγc ligand is expressed, IL-2 receptors on the cell become activated leading to long-term persistence of the cell.

As an example, a novel chimeric IL-2/IL-2Rβ fusion protein of IL-2 and its receptor subunit, IL-2Rβ, joined via a peptidyl linker (CIRB) has been reported. NK-92 cells expressing CIRB (NK-92$^{CIRB}$) were highly activated and expanded indefinitely without exogenous IL-2. When compared with an IL-2-secreting NK-92 cell line, NK-92$^{CIRB}$ cells were more activated, cytotoxic, and resistant to growth inhibition than were NK-92 cells. In the presence of cancer cells, NK-92$^{CIRB}$ cells exhibited enhanced cytotoxicity resulting in superior in vivo antitumor effects in mice.

As another example, co-expression of both a CAR and membrane-bound chimeric IL-15 (mbIL15) has been reported. IL-15 is known to act by activating IL-2Rβγc. The mbIL15-CAR T-cells showed T-cell persistence independent of CAR signaling and achieved potent rejection of CD19$^+$ leukemia in an animal model. Long-lived T-cells possessed a memory-like transcriptional profile. The results demonstrated that CAR$^+$ T-cells can be developed long-term persistence with a memory stem-cell phenotype sustained by signaling through mbIL15.

DNA encoding an IL-2Rβγc ligand can be incorporated into a cell and can be configured to produce an IL-2Rβγc ligand provided by the present disclosure. The IL-2Rβγc ligand can be secreted from the cell and can interact with the secreting cells (i.e., autocrine signaling) and/or cells in the vicinity of the secreting cell (i.e., paracrine signaling). A secreted IL-2Rβγc ligand or IL-2Rβγc ligand construct provided by the present disclosure can be an IL-2R agonist and can be designed to localize near the secreting cell.

An IL-2Rβγc ligand or IL-2Rβγc ligand construct provided by the present disclosure can be used to expand non-regulatory T-cells within a patient or within a biological sample. Methods of increasing the ratio of non-regulatory T-cells to Treg cells can comprise contacting a population of T-cells with an effective amount of an IL-2Rβγc ligand or IL-2Rβγc ligand construct. The ratio can be measured by determining the ratio of CD3+FOXP3+ cells to CD3+FOXP3-cells within the population of T-cells. A typical Treg frequency in human blood is 5% to 10% of the total CD4+CD3+ T-cells, however, in certain diseases this percentage may be lower or higher.

An IL-2Rβγc ligand or IL-2Rβγc ligand construct may be used to expand NK cells. NK cells modified with chimeric antigen receptors (CARs), which redirect immune cell activity to target cancer cells have been demonstrated to exhibit improved antitumor responses. CARs can comprise an antibody-derived extracellular domain, which binds to the desired tumor-associated antigen (TAA) and triggers an intracellular signaling cascade to activate the immune cell against the target cells.

NK cells can be genetically engineered for enhanced expression of one or more tumor targeting receptors such as NKG2D with membrane-bound IL-2Rβγc ligand, which can prolong the persistence and potency of the NK cells.

CAR T-cells can be genetically engineered to co-express a tethered form of an IL-2Rβγc ligand provided by the present disclosure to support in vivo persistence and maintenance of an immature state of differentiation and to exhibit in vivo antitumor activity.

IL-2Rβγc binding compounds, i.e., IL-2Rβγc ligands, tandem IL-2Rβγc ligands, and IL-2Rβγc ligand constructs provided by the present disclosure, can be incorporated into pharmaceutical compositions to be administered to a patient by any appropriate route of administration including intradermal, intramuscular, intraperitoneal, intravenous, subcutaneous, intranasal, epidural, oral, peroral, sublingual, intracerebral, intravaginal, transdermal, rectal, inhalation, or topical. A pharmaceutical composition provided by the present disclosure can be an injectable formulation. Pharmaceutical compositions provided by the present disclosure can be injectable intravenous formulations. Pharmaceutical compositions provided by the present disclosure can be oral formulations. Oral formulations may be oral dosage forms. A pharmaceutical composition may be formulated for intravenous administration or for subcutaneous administration.

Pharmaceutical compositions provided by the present disclosure may comprise a therapeutically effective amount of an IL-2Rβγc binding compound together with a suitable amount of one or more pharmaceutically acceptable vehicles so as to provide a composition for proper administration to a patient. Suitable pharmaceutical vehicles and methods of preparing pharmaceutical compositions are described in the art.

Assessing single patient response to therapy and qualifying a patient for optimal therapy are among the greatest challenges of modern healthcare and relate to trends in personalized medicine. IL-2Rβγc binding compounds can have target selectivity, for example, for certain cancers and immune cells. IL-2Rβγc binding compounds radiolabeled for positron emission tomography (PET) or Single Photon Emission Computed Tomography (SPECT) can be used to predict the targeting of the treatment based on a single-study, case-by-case patient analysis thus excluding patients that are expected not to benefit from treatment. PET/SPECT scans using IL-2Rβγc binding compounds, once correlated to the concentration can provide a three-dimensional distribution map, which can then be used for macroscopic dose calculations.

Accordingly, it is within the capability of those of skill in the art to assay and use IL-2Rβγc binding compounds and/or pharmaceutical compositions thereof for therapy.

IL-2Rβγc binding compounds, and/or pharmaceutical composition thereof can generally be used in an amount effective to achieve the intended purpose. For use to treat a disease such as cancer, an autoimmune disease or an inflammatory disease, an IL-2Rβγc binding compound, and/or pharmaceutical composition thereof, may be administered or applied in a therapeutically effective amount.

The amount of an IL-2Rβγc binding compound, and/or pharmaceutical composition of any of the foregoing that will be effective in the treatment of a particular disorder or condition disclosed herein will depend in part on the nature of the disorder or condition, and can be determined by standard clinical techniques known in the art. In addition, in vitro or in vivo assays may optionally be employed to help identify optimal dosage ranges. The amount of an IL-2Rβγc binding compound, and/or pharmaceutical composition of any of the foregoing administered will depend on, among other factors, the patient being treated, the weight of the patient, the severity of the affliction, the manner of administration and the judgment of the prescribing physician.

An IL-2Rβγc binding compound can be assayed in vitro and in vivo, for the desired therapeutic activity, prior to use in humans. For example, in vitro assays may be used to determine whether administration of a specific compound or a combination of compounds is preferred. The compounds can also be demonstrated to be effective and safe using animal model systems.

In certain embodiments, a therapeutically effective dose of an IL-2Rβγc binding compound, and/or pharmaceutical composition of any of the foregoing will provide therapeutic benefit without causing substantial toxicity. Toxicity of an IL-2Rβγc binding compound, and/or pharmaceutical compositions of any of the foregoing may be determined using standard pharmaceutical procedures and may be readily ascertained by the skilled artisan. The dose ratio between toxic and therapeutic effect is the therapeutic index. An IL-2Rβγc binding compound, and/or pharmaceutical composition of any of the foregoing exhibits a particularly high therapeutic index in treating disease and disorders. A dose of an IL-2Rβγc binding compound, and/or pharmaceutical composition of any of the foregoing will be within a range of circulating concentrations that include an effective dose with minimal toxicity.

An IL-2Rβγc binding compounds provided by the present disclosure or a pharmaceutical composition thereof may be included in a kit that may be used to administer the compound to a patient for therapeutic purposes. A kit may include a pharmaceutical composition comprising an IL-2Rβγc binding compounds provided by the present disclosure suitable for administration to a patient and instructions for administering the pharmaceutical composition to the patient. The kit can be a kit for treating cancer, for treating an autoimmune disease, or for treating an inflammatory disease. A kit for use in treating cancer in a patient can comprise an IL-2Rβγc binding compound provided by the present disclosure, a pharmaceutically acceptable vehicle for administering the compound, and instructions for administering the compound to a patient.

The pharmaceutical compositions can be included in a container, pack, or dispenser together with instructions for administration.

Instructions supplied with a kit may be printed and/or supplied, for example, as an electronic-readable medium, a video cassette, an audiotape, a flash memory device, or may be published on an internet web site or distributed to a patient and/or health care provider as an electronic communication.

An IL-2Rβγc binding compound provided by the present disclosure can be useful when combined with certain vaccines, including cancer neo-antigen vaccines. Mutations in tumor DNA produces new protein sequences that are foreign to the body. Vaccines can be designed to specifically activate a patient's immune system with respect to tumor-specific neo-antigens. When administered in combination with a neo-antigen vaccine, an IL-2Rβγc binding compound provided by the present disclosure can expand and proliferate neo-antigen-specific T-cells in the tumor microenvironment and thereby drive maximal expansion of vaccine-induced neo-antigen-specific T-cells for the treatment of cancer.

An IL-2Rβγc binding compound provided by the present disclosure can be used as an adjuvant. An adjuvant refers to a compound that enhances the efficacy of a vaccine without directly participating in the protective immunity. For example, an IL-2Rβγc binding compound provided by the present disclosure can be used in conjunction with a cancer vaccine or a viral vaccine.

An IL-2Rβγc binding compound provided by the present disclosure can be useful for cell therapy when engineered to be expressed on the membrane surface of cells that also express the IL-2Rβ and Rγc subunits. Adoptive immunotherapy using NK cells or using re-targeted chimeric antigen receptor (CAR) T-cells is currently being studied as a treatment for neoplasms and viral infections. One challenge with these cell therapies is the suboptimal sustained survival of the infused cells.

DNA encoding a ligand fused to a membrane protein in such a way that the IL-2Rβγc binding compound is expressed on the extracellular surface of a cell can be constructed using standard techniques. When a fusion protein comprising an IL-2Rβγc ligand and/or an IL-2Rβγc ligand is expressed, IL-2 receptors on the cell become activated leading to long-term persistence of the cell.

DNA encoding a ligand can be incorporated into a cell and can be configured to produce an IL-2Rβγc binding compound provided by the present disclosure. An IL-2Rβγc binding compound can be secreted from the cell and can interact with the secreting cells (i.e., autocrine signaling) and/or cells in the vicinity of the secreting cell (i.e., paracrine signaling). A secreted IL-2Rβγc binding compound provided by the present disclosure can be an IL-2R agonist and can be designed to localize near the secreting cell.

An IL-2Rβγc binding compound provided by the present disclosure can be used to expand T-cells within a patient or within a biological sample. Methods of increasing the ratio of non-regulatory T-cells to Treg cells can comprise contacting a population of T-cells with an effective amount of an IL-2Rβγc binding compound. The ratio can be measured by determining the ratio of CD3+FOXP3+ cells to CD3+FOXP3-cells within the population of T-cells. A typical Treg frequency in human blood is 5% to 10% of the total CD4+CD3+ T-cells, however, in certain diseases this percentage may be lower or higher.

An IL-2Rβγc binding compound may be used to expand T-cells. T-cells modified with chimeric antigen receptors (CARs), which redirect immune cell activity to target cancer cells have been demonstrated to exhibit improved antitumor responses. CARs can comprise an antibody-derived extracellular domain, which binds to the desired tumor-associated antigen (TAA) and triggers an intracellular signaling cascade to activate the immune cell against the target cells.

An IL-2Rβγc binding compound that are immobilized to a surface can be exposed to populations of T-cells in vitro or ex vivo to induce expansion of the cell population. Prior to transfer to a patient. CAR-T cells can be expanded by exposure to an immobilized form of an IL-2Rβγc binding compound. An immobilized an IL-2Rβγc binding compound can be separated from the CAR-T cells prior to transfer of the CAR-T cells to a patient.

CAR T-cells can be genetically engineered to co-express a tethered form of an IL-2Rβγc binding compound provided by the present disclosure to support in vivo persistence and maintenance of an immature state of differentiation and to exhibit in vivo antitumor activity.

Assessing single patient response to therapy and qualifying a patient for optimal therapy are among the greatest challenges of modern healthcare and relate to trends in personalized medicine. An IL-2Rβγc binding compound can have target selectivity, for example, for certain cancers and immune cells. An IL-2Rβγc binding compound radiolabeled for positron emission tomography (PET) or Single Photon Emission Computed Tomography (SPECT) can be used to predict the targeting of the treatment based on a single-study, case-by-case patient analysis thus excluding patients that are expected not to benefit from treatment. PET/SPECT scans using IL-2Rβγc binding compounds, once correlated to the concentration can provide a three-dimensional distribution map, which can then be used for dose calculations.

An IL-2Rβγc binding compound can comprise one or more imaging agents. An IL-2Rβγc binding compound can direct and localize the compound to cells, populations of cells, and tissue expressing IL-2R. The imaging compounds can comprise one or more imaging agents such as radiolabels, fluorescent labels, enzymatic labels, or PET imaging agents.

The imaging agents can be used to determine the number of cells expressing IL-2R, the expression level of cells expressing IL-2R, or properties of IL-2R such as the binding affinity of a particular IL-2Rβγc binding compound to IL-2R. The imaging agents can be used, for example, to evaluate cancer cells expressing the IL-2Rβ subunit and the Rγc subunit, or to evaluate Treg and/or Teff cells.

The label can be detected to determine a biodistribution of the compound in a patient or to assess the potential for therapeutic efficacy. For example, tumors expressing high levels of IL-2R may be attractive targets for therapeutic IL-2Rβγc binding compounds provided by the present disclosure.

The imaging agents can be used to evaluate cells expressing IL-2R before therapy, during therapy, and/or following therapy.

Imaging agents comprising a ligand can further comprise a moiety capable of binding to a cell surface and in particular to a protein expressed on the cell surface. The protein can be indicative of a certain cell type and is referred to as a cell surface marker. Imaging agents comprising both a ligand and a cell surface marker can be used to assess cells, a population of cells, and/or a tissue expressing IL-2R and the cell surface marker. Assessment can include determining the number of cells expressing IL-2R and the cell surface marker, the expression levels of IL-2R and the cell surface marker, and/or the binding affinity of the imaging agent to IL-2R and/or to the cell surface marker.

The imaging agents can be used to evaluate cells expressing IL-2R and the cell surface marker before therapy, during therapy, and/or following therapy.

An IL-2Rβγc binding compound provided by the present disclosure can be labeled. Labeled compounds can be useful in diagnostics.

An IL-2Rβγc binding compound provided by the present disclosure can be labeled with a detectable marker. The label can be used to determine a biodistribution of the compound in a patient or to assess the potential for therapeutic efficacy. For example, tumors expressing high levels of IL-2R may be attractive targets for selective IL-2R agonists and IL-2Rβγc binding compounds provided by the present disclosure.

An IL-2Rβγc binding compound provided by the present disclosure include labeled compounds. A labeled compound can be a detectable marker, for example, a radiolabeled amino acid or an attachment of biotinyl moieties to a polypeptide, wherein the attached biotinyl moieties can be detected by marked avidin such as streptavidin containing a fluorescent marker or enzymatic activity that can be detected by optical or colorimetric methods. Various methods of labeling polypeptides and glycoproteins are known in the art and may be used. Examples of labels for polypeptides include, for example, a radioisotope such as, $^{3}H$, $^{14}C$, $^{35}S$, $^{125}I$, and $^{131}I$, a fluorescent labels such as FITC, rhodamine, and lanthanide phosphors, an enzymatic label such as horseradish peroxidase, β-galactosidase, luciferase, and alkaline phosphatase, biotinyl groups, predetermined polypeptide epitopes recognized by a secondary reporter such as leucine zipper pair sequences, binding sites for secondary antibodies, metal ligands, and epitope tags. A label can be attached by spacer arms of various lengths to reduce potential steric hindrance.

An IL-2Rβγc binding compound provided by the present disclosure can be used, for example, to treat diseases such as cancer, an inflammatory disease, an autoimmune disease, an immunodeficiency or an infectious disease, including a viral disease such as COVID-19.

An IL-2Rβγc binding compound provided by the present disclosure and pharmaceutical compositions of any of the foregoing may be administered to a patient to treat an organ transplant.

An IL-2Rβγc binding compound provided by the present disclosure and pharmaceutical compositions of any of the foregoing may be administered to a patient together with another compound for treating an inflammatory disease or an autoimmune disease in the subject. The at least one other therapeutic agent may be an IL-2Rβγc binding compound provided by the present disclosure. An IL-2Rβγc binding compound and the at least one other therapeutic agent may act additively or synergistically. The at least one additional therapeutic agent may be included in the same pharmaceutical composition or vehicle comprising the IL-2Rβγc binding compound or may be in a separate pharmaceutical composition or vehicle. Accordingly, methods provided by the present disclosure further include, in addition to administering an IL-2Rβγc binding compound, administering one or more therapeutic agents effective for treating an inflammatory disease or an autoimmune disease or a different disease, disorder or condition than an inflammatory disease or an autoimmune disease. Methods provided by the present disclosure include administration of an IL-2Rβγc binding compound and one or more other therapeutic agents provided that the combined administration does not inhibit the therapeutic efficacy of an IL-2Rβγc binding compound and/or does not produce adverse combination effects.

An IL-2Rβγc binding compound provided by the present disclosure comprise treating a disease in a patient such as cancer, an inflammatory disease, or an autoimmune disease comprising administering to a patient in need thereof a therapeutically effective amount of a compound capable of binding to the specific binding site of the IL-2Rβ subunit and/or the Rγc subunit of IL-2R with an $IC_{50}$ of less than 100 μM, less than 10 μM, less than 1 μM, less than 100 nM, or less than 10 nM.

IL-2Rβγc binding compounds provided by the present disclosure may be used for treating cancer in a patient. The cancer can be, for example, a solid tumor or a metastasis.

IL-2Rβγc binding compounds provided by the present disclosure or a pharmaceutical composition thereof may be administered to treat a cancer known to be treated by activation of IL-2R. IL-2Rβγc binding compounds provided by the present disclosure or a pharmaceutical composition thereof may be administered to treat a cancer known to be treated by activation of the IL-2Rβγc subunits and where simultaneous activation of the IL-2Rα subunit compromises therapeutic efficacy and/or induces unwanted side effects.

IL-2Rβγc binding compounds provided by the present disclosure or pharmaceutical compositions thereof can be used to treat, for example, one or more of the following cancers: acute lymphoblastic leukemia, acute myeloid leukemia, adrenocortical carcinoma, appendix cancer, astrocytoma, atypical teratoid/rhabdoid tumor, basal cell carcinoma (nonmelanoma), B-cell lymphoma, bladder cancer, bone cancer, brain and spinal cord tumors, brain stem cancer, brain tumor, breast cancer, bronchial tumors, Burkitt lymphoma, carcinoid tumor, carcinoma of head and neck, central nervous system embryonal tumors, cerebellar astrocytoma, cerebral astrocytoma/malignant glioma, cervical cancer, chordoma, chronic lymphocytic leukemia, chronic myelogenous leukemia, colorectal cancer, craniopharyngioma, cutaneous T-cell lymphoma, desmoplastic small round cell tumor, ductal carcinoma, dye cancer, endocrine pancreas tumors (islet cell tumors), endometrial cancer, ependymoblastoma, esophageal cancer, esthesioneuroblastoma, Ewing family of tumors, extracranial germ cell tumor, extrahepatic bile duct cancer, gallbladder cancer, gastric cancer, gastrointestinal carcinoid tumor, gastrointestinal stromal tumor, gestational trophoblastic tumor, glioblastoma, glioma, hairy cell leukemia, head and neck cancer, heart cancer, hematopoetic tumors of the lymphoid lineage, hepatocellular cancer, Hodgkin lymphoma, hypopharyngeal cancer, hypothalamic and visual pathway glioma, IDs-related lymphoma, intraocular melanoma, islet cell tumors, Kaposi sarcoma, kidney cancer, Langerhans cell histiocytosis, laryngeal cancer, leukemia, lip and oral cavity cancer, male breast cancer, malignant fibrous histiocytoma, malignant germ cell tumors, malignant mesothelioma, medulloblastoma, melanoma, Merkel cell carcinoma, mesothelioma, mouth cancer, multiple endocrine neoplasia syndrome, multiple myeloma, mycosis fungoides, myelodysplastic, myeloproliferative neoplasms, nasal cavity and paranasal sinus cancer, nasopharyngeal cancer, neuroblastoma, non-Hodgkin lymphoma, non-small cell lung cancer, oral cancer, oropharyngeal cancer, osteosarcoma, ovarian cancer, ovarian epithelial cancer, ovarian germ cell tumor, ovarian low malignant potential tumor, pancreatic cancer, pancreatic neuroendocrine tumors (islet cell tumors), papillomatosis, paraganglioma, paranasal sinus and nasal cavity cancer, parathyroid cancer, penile cancer, pharyngeal cancer, pheochromocytoma, pineal parenchymal tumors, pineoblastoma and supratentorial primitive neuroectodermal tumors, pituitary tumor, plasma cell neoplasm/multiple myeloma, pleuropulmonary blastoma, pregnancy and breast cancer, primary central nervous system lymphoma, primary liver cancer, primary metastatic squamous neck cancer with occult, prostate cancer, rectal cancer, renal cell cancer, renal pelvis and ureter, respiratory tract carcinoma, retinoblastoma, rhabdomyosarcoma, salivary gland cancer, sarcoma, Sézary syndrome, skin cancer, small intestine cancer, soft tissue sarcoma, squamous cell carcinoma (nonmelanoma), stomach cancer, supratentorial primitive neuroectodermal tumors, T-cell lymphoma, testicular cancer, throat cancer, thymoma and thymic carcinoma, thyroid cancer, transitional cell cancer, urethral cancer, uterine sarcoma, vaginal cancer, visual pathway and hypothalamic glioma, vulvar cancer, Waldenström macroglobulinemia, Wilms tumor, and systemic and central metastases of any of the foregoing.

IL-2Rβγc binding compounds provided by the present disclosure or pharmaceutical compositions thereof can be used to treat solid tumors.

IL-2Rβγc binding compounds provided by the present disclosure or pharmaceutical compositions thereof can be used to treat tumor metastases.

IL-2Rβγc binding compounds provided by the present disclosure or pharmaceutical compositions thereof can be used to treat circulating tumor cells.

IL-2Rβγc binding compounds provided by the present disclosure or pharmaceutical compositions thereof can be used to treat, for example, a cancer selected from primary adult and childhood brain and CNS cancers including glioblastoma (GBM) and astrocytoma, skin cancers including melanoma, lung cancers including small cell lung cancers, non-small cell lung cancers (NSCLC), and large cell lung cancers, breast cancers including triple negative breast cancer (TNBC), blood cancers including myelodysplastic syndrome (MDS), multiple myeloma (MM), and acute myeloid leukemia (AML), prostate cancer including castrate resistant prostate cancer (CRPC), liver cancers including hepatocellular carcinoma (HCC), esophageal and gastric cancers, and any systemic and central metastases of any of the foregoing.

The amount of an IL-2Rβγc binding compound provided by the present disclosure, or pharmaceutical composition thereof that will be effective in the treatment of a cancer can depend, at least in part, on the nature of the disease, and may be determined by standard clinical techniques known in the art. In addition, in vitro or in vivo assays may be employed to help identify optimal dosing ranges. Dosing regimens and dosing intervals may also be determined by methods known to those skilled in the art. The amount of an IL-2Rβγc binding compound provided by the present disclosure administered may depend on, among other factors, the patient being treated, the weight of the patient, the severity of the disease, the route of administration, and the judgment of the prescribing physician.

For systemic administration, a therapeutically effective dose may be estimated initially from in vitro assays. Initial doses may also be estimated from in vivo data, e.g., animal models, using techniques that are known in the art. Such information may be used to more accurately determine useful doses in humans. One having ordinary skill in the art may optimize administration to humans based on animal data.

A dose of an IL-2Rβγc binding compound provided by the present disclosure and appropriate dosing intervals may be selected to maintain a sustained therapeutically effective concentration of the IL-2Rβγc binding compound provided by the present disclosure in the blood of a patient, and in certain embodiments, without exceeding a minimum adverse concentration.

A pharmaceutical composition comprising an IL-2Rβγc binding compound provided by the present disclosure may be administered, for example once per week, every 2 weeks, every 3 weeks, every 4 weeks, every 5 weeks, or every 6 weeks. Dosing may be provided alone or in combination with other drugs and may continue as long as required for effective treatment of the disease. Dosing may also be undertaken using continuous or semi-continuous administration over a period of time. Dosing includes administering a pharmaceutical composition to a mammal, such as a human, in a fed or fasted state.

A pharmaceutical composition may be administered in a single dosage form or in multiple dosage forms or as a continuous or an accumulated dose over a period of time. When multiple dosage forms are used the amount of an IL-2Rβγc binding compound provided by the present disclosure contained within each of the multiple dosage forms may be the same or different.

Suitable daily dosage ranges for administration can range, for example, from about 2 µg to about 200 mg of an IL-2Rβγc binding compound provided by the present disclosure per kilogram body weight.

Suitable daily dosage ranges for administration may range, for example, from about 1 µg to about 50 mg of an IL-2Rβγc binding compound provided by the present disclosure per square meter ($M^2$) of body surface.

An IL-2Rβγc binding compound provided by the present disclosure may be administered to treat cancer in a patient in an amount, for example, from 0.001 mg/day to 100 mg/day, or in any other appropriate daily dose. A dose can be, for example, from 0.01 µg/kg body weight/week to 100 µg/kg body weight/week or any other suitable dose.

A pharmaceutical composition comprising an IL-2Rβγc binding compound provided by the present disclosure may be administered to treat cancer in a patient so as to provide a therapeutically effective concentration of an IL-2Rβγc binding compound provided by the present disclosure in the blood or plasma of the patient. A therapeutically effective concentration of a compound of an IL-2Rβγc binding compound provided by the present disclosure in the blood of a patient can be, for example, from 0.01 µg/L to 1,000 µg/L, from 0.1 µg/L to 500 µg/L, from 1 µg/L to 250 µg/L, or from about 10 µg/L to about 100 µg/L. A therapeutically effective concentration of an IL-2Rβγc binding compound provided by the present disclosure in the blood of a patient can be, for example, at least 0.01 µg/L, at least 0.1 µg/L, at least 1 µg/L, at least about 10 µg/L, or at least 100 µg/L. A therapeutically effective concentration of an IL-2Rβγc binding compound in the blood of a patient can be, for example, less than an amount that causes unacceptable adverse effects including adverse effects to homeostasis. A therapeutically effective concentration of an IL-2Rβγc binding compound in the blood of a patient can be an amount sufficient to restore and/or maintain homeostasis in the patient.

Pharmaceutical compositions comprising an IL-2Rβγc binding compound may be administered to treat a disease in a patient so as to provide a therapeutically effective concentration of the IL-2Rβγc binding compound in the blood of a patient for an extended period of time such as, for example, for at least 1 day, for at least 1 week, at least 2 weeks, at least 4 weeks, at least 5 week, or at least 6 weeks.

The amount of an IL-2Rβγc binding compound administered may vary during a treatment regimen.

Pharmaceutical compositions provided by the present disclosure may further comprise one or more pharmaceutically active compounds in addition to an IL-2Rβγc binding compound provided by the present disclosure. Such compounds may be provided, for example, to treat the cancer being treated with the IL-2Rβγc binding compound or to treat a disease, disorder, or condition other than the cancer being treated with the IL-2Rβγc binding compound, to treat a side-effect caused by administering the IL-2Rβγc binding compound, to augment the efficacy of the IL-2Rβγc binding compound, and/or to modulate the activity of the IL-2Rβγc binding compound.

An IL-2Rβγc binding compound provided by the present disclosure may be used in combination with at least one other therapeutic agent. An IL-2Rβγc binding compound may be administered to a patient together with another compound for treating cancer in the patient. The at least one other therapeutic agent can be a second, different IL-2Rβγc binding compound. An IL-2Rβγc binding compound and the at least one other therapeutic agent may act additively or, and in certain embodiments, synergistically with another IL-2Rβγc binding compound. The at least one additional therapeutic agent may be included in the same pharmaceutical composition or vehicle comprising the IL-2Rβγc binding compound or may be in a separate pharmaceutical composition or vehicle. Accordingly, methods provided by the present disclosure further include, in addition to administering an IL-2Rβγc binding compound, administering one or more therapeutic agents effective for treating cancer or a different disease, disorder or condition than cancer. Methods provided by the present disclosure include administration of an IL-2Rβγc binding compound and one or more other therapeutic agents provided that the combined administration does not inhibit the therapeutic efficacy of the IL-2Rβγc binding compound and/or does not produce adverse combination effects.

A pharmaceutical composition comprising an IL-2Rβγc binding compound may be administered concurrently with the administration of another therapeutic agent, which may be part of the same pharmaceutical composition as, or in a different pharmaceutical composition than that comprising an IL-2Rβγc binding compound. An IL-2Rβγc binding compound may be administered prior or subsequent to administration of another therapeutic agent. In certain combination therapies, the combination therapy may comprise alternating between administering an IL-2Rβγc binding compound and a composition comprising another therapeutic agent, e.g., to minimize adverse drug effects associated with a particular drug. When an IL-2Rβγc binding compound is administered concurrently with another therapeutic agent that potentially may produce an adverse drug effect including, for example, toxicity, the other therapeutic agent may be administered at a dose that falls below the threshold at which the adverse drug reaction is elicited.

A pharmaceutical composition comprising an IL-2Rβγc binding compound provided by the present disclosure may be administered with one or more substances, for example, to enhance, modulate and/or control release, bioavailability, therapeutic efficacy, therapeutic potency, and/or stability, of the IL-2Rβγc binding compound. For example, a pharmaceutical composition comprising an IL-2Rβγc binding compound can be co-administered with an active agent having pharmacological effects that enhance the therapeutic efficacy of the IL-2Rβγc binding compound.

An IL-2Rβγc binding compound, or a pharmaceutical composition thereof may be administered in conjunction with an agent known or believed to be effective in treating a disease such as cancer, an autoimmune disease or an inflammatory disease in a patient, such as the same disease being treated with the IL-2Rβγc binding compound.

An IL-2Rβγc binding compound, or a pharmaceutical composition thereof may be administered in conjunction with an agent known or believed to interfere with cell proliferation.

An IL-2Rβγc binding compound, or a pharmaceutical composition thereof may be administered in conjunction with an agent known or believed to interfere with cellular metabolism, to be an anti-metabolite, to interfere with RNA transcription, to interfere with RNA translation, to interfere with cellular protein synthesis, to interfere with synthesis of precursors for DNA synthesis and replication, to interfere with purine synthesis, to interfere with nucleoside synthesis, to interact with mTOR, to be an mTOR inhibitor, to interfere with cell cycle checkpoints.

An IL-2Rβγc binding compound or a pharmaceutical composition thereof may be administered in conjunction with a checkpoint inhibitor including a CTLA-4 inhibitor such as ipilimumab, a PD-1 inhibitor such as pembrolizumab and nivolumab, and/or a PD-LI inhibitor such as atezolizumab, avelumab, and durvalumab. An IL-2Rβγc binding compound or a pharmaceutical composition thereof may be administered in conjunction with an immunomodulator such as CD137/4-1BB, CD27, GIYR, and/or OC40.

An IL-2Rβγc binding compound or a pharmaceutical composition thereof may be administered in conjunction with an agent known or believed to be cytotoxic, to cause DNA damage, to cause cell cycle arrest, or to cause mitotic catastrophe.

An IL-2Rβγc binding compound or a pharmaceutical composition thereof may be administered in conjunction with an agent known or believed to modulate glutathione concentration, to modulate glutathione concentration within cells, to decrease glutathione concentration within cells, to reduce glutathione uptake into cells, to reduce glutathione synthesis, or to reduce glutathione synthesis within cells.

An IL-2Rβγc binding compound or a pharmaceutical composition thereof may be administered in conjunction with an agent known or believed to interfere with neovascularization, to reduce neovascularization, or to promote neovascularization.

An IL-2Rβγc binding compound or a pharmaceutical composition thereof may be administered in conjunction with an agent known or believed to interfere with hormone homeostasis, to interfere with hormone synthesis, to interfere with hormone receptor binding, or to interfere with hormone signal transduction.

An IL-2Rβγc binding compound or a pharmaceutical composition thereof may be administered in conjunction with an agent known or believed to interfere with growth factor homeostasis, to interfere with growth factor receptor expression, to interfere with growth factor binding to growth factor receptors, to interfere with growth factor receptor signal transduction, to interfere with the Hedgehog (Hh) signaling, to inhibit the Hedgehog pathway signaling, to inhibit ALK (anaplastic lymphoma kinase) pathway signaling, or to inhibit the non-homologous end joining (NHEJ) pathway.

An IL-2Rβγc binding compound or a pharmaceutical composition thereof may be administered in conjunction with one or more agents known or believed to be a VEGFR (vascular endothelial growth factor receptor) inhibitor, a RTK (receptor tyrosine kinase) inhibitor, a sodium channel current blocker, aFAK (focal adhesion kinase) inhibitor, a GLI (glioma-associated oncogene) inhibitor, a GLI1 inhibitor, a GLI2 inhibitor, a GLI3 inhibitor, a MAPK (mitogen-activated protein kinase) inhibitor, a MAPK/ERK pathway (also known as Ras-Raf-MEK-ERK pathways) inhibitor, a MEK1 inhibitor, a MEK2 inhibitor, a MEK5 inhibitor, a MEK5/ERK5 inhibitor, aRTA (renal tubular acidosis) inhibitor, a ALK (anaplastic lymphoma kinase) inhibitor, Aa LK kinase inhibitor, a nuclear translocation inhibitor, a PORCN (porcupine) inhibitor, a 5-ARI (5α-reductase inhibitor), topoisomerase inhibitor, a Ras (rat sarcoma) inhibitor, a K-ras inhibitor, a CERK (ceramide kinase) inhibitor, a PKB (protein kinase B, also known as AKT) inhibitor, a AKT1 inhibitor, EZH2 (enhancer of zeste homolog 2) inhibitor, a BET (bromodomain and extraterminal domain motif) inhibitor, a SYK (spleen tyrosine kinase) inhibitor, JAK (janus kinase) inhibitors, a SYK/JAK inhibitor, a IDO (indoleamine-pyrrole 2,3-dioxygenase) inhibitor, a IDO1 inhibitor, a RXR (retinoic X receptors) activating agent, a selective RXR activating agent, a p-glycoprotein inhibitor, a ERK inhibitor, a PI3K (phosphatidylinositol-4,5-bisphosphate 3-kinase) inhibitor, a BRD (bromodomain-containing protein) inhibitor, a BRD2 inhibitor, a BRD3 inhibitor, a BRD4 inhibitor, a BRDT (bromodomain testis-specific protein) inhibitor, a reverse transcriptase inhibitor, a NRT (nucleoside analog reverse-transcriptase) inhibitor, a PIM (proviral integrations of moloney virus) inhibitor, a EGFR (epidermal growth factor receptor) inhibitor, a photosensitizer, a radiosensitizer, a ROS (proto-oncogene, receptor tyrosine kinase) inhibitor, a ROS1 (proto-oncogene 1) inhibitor, a CK (casein kinase) inhibitor, a CK2 inhibitor, a Bcr-Abl (breakpoint cluster region—Abelson proto-oncogene) tyrosine-kinase inhibitor such as dasatinib, a microtubule stabilizing agent, a microtubule depolymerization/disassembly inhibitor, a DNA intercalator, an androgen receptor antagonist, a chemoprotective agents, a HDAC (histone deacetylase) inhibitor, a DPP (dipeptidyl peptidase) inhibitor, a DPP-4 inhibitor, BTK (Bruton's tyrosine kinase) inhibitor, a kinase inhibitor such as imatinib, a tyrosine kinase inhibitor such as nilotinib, a ARP (poly (ADP-ribose) polymerase) inhibitor, a CDK (cyclin-dependent kinase) inhibitor, a CDK4 inhibitor, a CDK6 inhibitor, a CDK4/6 inhibitor, a HIF1α (hypoxia-inducible factor 1-α) inhibitor, a DNA ligase inhibitor, a DNA ligase IV inhibitor, a NHEJ (non-homologous end joining) inhibitor, a DNA ligase IV, a NHEJ inhibitor and a RAF inhibitor, a TKI and a RAF inhibitor, a TKI and RAF inhibitor such as sorafenib, a PDT (photodynamic therapy) sensitizer, an ATR (ataxia telangiectasia- and Rad3-related protein kinase) inhibitor, or a combination of any of the foregoing.

An IL-2Rβγc binding compound or a pharmaceutical composition thereof may be administered in conjunction with one or more chemotherapeutic agents, such as, for example, a VEGFR inhibitor such as fruquintinib, motesanib/AMG-706, vatalanib; a RTK inhibitor such as ponatinib; a sodium channel blocker such as GS967; a FAK inhibitor such as TAE226; a GLI1 and GLI2 inhibitor such as GANT61, a MEK inhibitor such as binimetinib; a RTA inhibitor such as linifanib; an ALK inhibitor such as brigstinib; bromopyruvic acid; a DNA alkylating agent such as thiotepa; nuclear translocations factors such as JSH-23; a PORCn inhibitor such as Wnt-C59; a 5α-reductase inhibitor such as dutasteride; a topoisomerase inhibitor such as carubicin; a RAS inhibitor such as Kobe0065; a CerK inhibitor such as NVP-231; an AKT inhibitor such as uprosertib; a EZH2 inhibitor such as GSK-503; a BET bromodomain inhibitor such as OTX015; a MEK5/ERK5 inhibitor such as BIX02189; a Syl/JAK inhibitor such as cerdulatinib; an IDO1 inhibitor such as NLG919; a retinoic X receptor activating agent such as bexsrotene; a PGP inhibitor such as acotiamide or actotiamide HCl; an Erk inhibitor such SCH772984; a PI3K inhibitor such as gedatolisib; a JAK inhibitor such as ruxolitinib; an AKT inhibitor such as afuresertib or afuresertib HCl; an ALK1 inhibitor such as ceritinib; an HDAC inhibitor such as abexinostat; a DPP inhibitor such as oamarigliptin; an EGFR inhibitor such as gefittinib; an EZH2 inhibitor such as GSK126; a BTK inhibitor such as ibrutinib; a kinase inhibitor such as imatinin HCl; an IDO inhibitor such as INCB024360; a DNA crosslinker such as mitomycin C; a tyrosine kinase inhibitor such as nilotinib, a PARP inhibitor such as olaparib; a tubulin stabilization promoter such as paclitaxel; a CDK4/6 inhibitor such as palbociclib; a RTK inhibitor such as sunitinib; a PDT sensitizer such as tslsporfin; a p-glycoprotein inhibitor such as tariquidar; an ATR inhibitor such as VE-822; an HDAC inhibitor such as PCI-24781; a DPP inhibitor such as omarigliptin; an EGFR inhibitor such as gefinib; an EZH2 inhibitor such as GSK126; a BTK inhibitor such as irbrutinib; an IDO inhibitor such as INCB024360; or a combination of any of the foregoing.

For example, an IL-2Rβγc binding compound or a pharmaceutical composition thereof may be administered in conjunction with another chemotherapeutic agent, such as, for example, N-acetyl cysteine (NAC), adriamycin, alemtuzumab, amifostine, arsenic trioxide, ascorbic acid, bendamustine, bevacizumab, bortezomib, busulfan, buthionine sulfoxime, carfilzomib, carmustine, clofarabine, cyclophosphamide, cyclosporine, cytarabine, dasatinib, datinomycin, defibrotide, dexamethasone, docetaxel, doxorubicin, etoposide, filgrastim, floxuridine, fludarabine, gemcitabine, interferon alpha, ipilimumab, lenalidomide, leucovorin, melphalan, mycofenolate mofetil, paclitaxel, palifermin, panobinostat, pegfilrastim, prednisolone, prednisone, revlimid, rituximab, sirolimus, sodium 2-mercaptoethane sulfonate (MESNA), sodium thiosulfate, tacrolimus, temozolomide, thalidomide, thioguanine, thiotepa, topotecan, velcade, or a combination of any of the foregoing.

An IL-2Rβγc binding compound or a pharmaceutical compositions thereof can be used in combination therapy with other chemotherapeutic agents including one or more antimetabolites such as folic acid analogs; pyrimidine analogs such as fluorouracil, floxuridine, and cytosine arabinoside; purine analogs such as mercaptopurine, thioguanine, and pentostatin; natural products such as vinblastine, vincristine, etoposide, tertiposide, dactinomycin, daunorubicin, doxorubicin, bleomycin, mithamycin, mitomycin C, L-asparaginase, and interferon alpha; platinum coordination complexes such as cis-platinum, and carboplatin; mitoxantrone; hydroxyurea; procarbazine; hormones and antagonists such as prednisone, hydroxyprogesterone caproate, medroxyprogesterone acetate, megestrol acetate, diethylstilbestrol, ethinyl estradiol, tamoxifen, testosterone propionate, fluoxymesterone, flutamide, and leuprolide, anti-angiogenesis agents or inhibitors such as angiostatin, retinoic acids, paclitaxel, estradiol derivatives, and thiazolopyrimidine derivatives; apoptosis prevention agents; triptolide; colchicine; luliconazole; and radiation therapy.

An IL-2Rβγc binding compound or a pharmaceutical composition thereof may be co-administered with a compound that inhibits DNA repair such as, for example, O6-benzylguanine (O6-BG).

An IL-2Rβγc binding compound or a pharmaceutical composition thereof may be administered in conjunction with one or more chemotherapeutic agents, such as, for example, abarelix, abiraterone, abiraterone acetate, n-acetyl cysteine, aclarubicin hydrochloride, adriamycin, adenine, afatinib, afatinib dimaleate, alemtuzumab, alendronate sodium, alitretinoin, allopurinol sodium, altretamine, amifostine, aminoglutethimide, aminolevulinic acid, amrubicin, amsacrine, anastrozole, angiostatin, apremilast, aprepitant, arsenic trioxide, ascorbic acid, 1-asparaginase, azacitidine, azathioprine sodium, bazedoxifene (serm), belinostat, bendamustine hcl, O6-benzylguanine, bevacizumab, bexaratene, bicalutamide, biricodar, bleomycin sulfate, bortezomib, bosutinib, brivudine, buserelin, busulfan, buthionine sulfoxime, cabazitaxel, cabozantinib, capecitabine, carboplatin, carboquone, carfilzomib, carmofur, carmustine, ceritinib, chlorambucil, cisplatin, cladribine, clodronate disodium, clofarabine, crizotinib, cyclophosphamide, cyclosporine, cytarabine, cytosine arabinoside, dabrafenib, dacarbazine, dactinomycin, dasatinib, datinomycin, daunorubicin, decitabine, defribrotide, degarelix acetate, dexamethasone, dexrazoxane hydrochloride, diaziquone, diethyl stilbestrol, docetaxel, doxifluridine, doxorubicin hydrochloride, doxorubicin free base, dromostanolone propionate, dutasteride, eltrombopag, enzalutamide, epirubicin hydrochloride, eribulin mesylate, erlotinib hydrochloride, estramustine phosphate sodium, ethinyl estradiol, etoposide phosphate, etoposide, everolimus, exemestane, fentanyl, filgrastim, fingolimod, floxuridine, fludarabine phosphate, fluorouracil, fluoxymesterone, flutamide, formestane, formylmelphalan, fosaprepitant, fotemustine, fulvestrant, gefitinib, gemcitabine hydrochloride, gemcitabine free base, glutathione, glyciphosphoramide, glyfosfin, goserelin acetate, granisetron hydrochloride, heptaplatin, hexyl 5-aminolevulinate, histrelin acetate, hydroxyprogesterone caproate, hydroxyurea, ibandronate sodium, ibrutinib, icotinib, idarubicin HCl, idelalisib, idoxuridine, ifosfamide, interferon alpha, imatinib mesylate, imiquimod, ingenol mebutate, ipilimumab, irinotecan hydrochloride, ixabepilone, lanreotide acetate, lapatinib free base, lapatinib ditosylate, lasofoxifene, lenalidomide, letrozole, leucovorin calcium, leuprolide acetate, levamisole hydrochloride, levoleucovorin calcium, iobenguane, lobaplatin, lomustine, maropitant, masoprocol, mechlorethamine hydrochloride, megestrol acetate, medroxyprogesterone acetate, melphalan hydrochloride, mercaptopurine, mercaptoethane sulfonate sodium, methotrexate, methoxsalen, methyl aminolevulinate, methylene blue, methylisoindigotin, mifamurtide, miltefosine, miriplatin, mithamycin, mitobronitol, mitomycin C, mitotane, mitoxantrone hydrochloride, mycophenolate mofetil, nabiximols, nafarelin, nandrolone, nedaplatin, nelarabine, netupitant, nilotinib, nilutamide, nimustine, nintedanib, nocodazole, octreotide, olaparib, omacetaxine mepesuccinate, ondansetron hydrochloride, oxaliplatin, paclitaxel, palbociclib, palifermin, palonosetron hydrochloride, pamidronate disodium, panobinostat, pasireotide, pazopanib hydrochloride, pegfilrastim, pemetrexed disodium, pentostatin, peplomycin, pipobroman, pirarubicin, plerixafor, plicamycin, pomalidomide, ponatinib, porfimer sodium, porfiromycin, pralatrexate, prednimustine, prednisolone, prednisone, procarbazine hydrochloride, quinagolide hydrochloride, raloxifene, raltitrexed, radotinib, ranimustine, retinoic acids, revlimide, rituxinab, romidepsin, ruxolitinib, ruxolitinib phosphate, semustine, sirolimus, sodium thiosulfate, sorafenib free base, sorafenib tosylate, streptozocin, sufentanil, sunitinib, tacrolimus, talaporfin sodium, tamibarotene, tamoxifen citrate, tapentadol, temoporfin, temozolomide, temsirolimus, teniposide, teriflunomide, tertiposide, testolactone, testosterone propionate, thalidomide, thioguanine, thiotepa, thymalfasin, toceranib phosphate, topotecan hydrochloride, toremifene citrate, trabectedin, trametinib, tretinoin, trilostane, triptorelin, tropisetron, uramustine, valrubicin, vandetanib, vedotin, vemurafenib, verteporfin, vinblastine, vincristine sulfate, vincristine free base, vindesine, vinorelbine tartrate, vorinostat, and zoledronic acid.

An IL-2Rβγc binding compound or a pharmaceutical composition thereof may be administered in conjunction with one or more chemotherapeutic agents such as, for example, abemaciclib, abiraterone acetate, ABVD, ABVE, ABVE-PC, AC, acalabrutinib, AC-T, ADE, ado-trastuzumab emtansine, afatinib dimaleate, aldesleukin, alectinib, alemtuzumab, alpelisib, amifostine, aminolevulinic acid hydrochloride, anastrozole, apalutamide, aprepitant, arsenic trioxide, asparaginase *Erwinia chrysanthemi*, atezolizumab, avelumab, axicabtagene ciloleucel, axitinib, azacitidine, BEACOPP, belinostat, bendamustine hydrochloride, BEP, bevacizumab, bexarotene, bicalutamide, binimetinib, bleomycin sulfate, blinatumomab, bortezomib, bosutinib, brentuximab vedotin, brigatinib, BuMel, busulfan, cabazitaxel, cabozantinib-s-malate, CAF, calaspargase pegol-mknl, capecitabine, caplacizumab-yhdp, CAPOX, carboplatin, carboplatin-taxol, carfilzomib, carmustine, carmustine implant, CEM, cemiplimab-rwlc, ceritinib, cetuximab, CEV, chlorambucil, chlorambucil-prednisone, CHOP, cisplatin, cladribine, clofarabine, CMF, cobimetinib, copanlisib hydrochloride, COPDAC, COPP, COPP-ABV, crizotinib, CVP, cyclophosphamide, cytarabine, cytarabine liposome, dabrafenib mesylate, dacarbazine, dacomitinib, dactinomycin, daratumumab, darbepoetin a, dasatinib, daunorubicin hydrochloride, daunorubicin hydrochloride and cytarabine liposome, decitabine, defibrotide sodium, degarelix, denileukin diftitox, denosumab, dexamethasone, dexrazoxane hydrochloride, dinutuximab, docetaxel, doxorubicin hydrochloride, doxorubicin hydrochloride liposome, durvalumab, duvelisib, elotuzumab, eltrombopag olamine, emapalumab-lzsg, enasidenib mesylate, encorafenib, enzalutamide, epirubicin hydrochloride, EPOCH, epoetin alfa, erdafitinib, eribulin mesylate, erlotinib hydrochloride, etoposide, etoposide phosphate, everolimus, exemestane, fec, filgrastim, fludarabine phosphate, fluorouracil injection, fluorouracil—topical, flutamide, folfiri, folfiri-bevacizumab, folfiri-cetuximab, folfirinox, folfox, fostamatinib disodium, FU-LV, fulvestrant, gefitinib, gemcitabine hydrochloride, gemcitabine-cisplatin, gemcitabine-oxaliplatin, gemtuzumab ozogamicin, gilteritinib fumarate, glasdegib maleate, glucarpidase, goserelin acetate, granisetron, HPV bivalent vaccine, HPV bivalent vaccine, recombinant HPV nonavalent vaccine, HPV nonavalent vaccine, recombinant, HPV quadrivalent vaccine, HPV uadrivalent vaccine recombinant, hydroxyurea, hyper-CVAD, ibritumomab tiuxetan, ibrutinib, ICE, idarubicin hydrochloride, idelalisib, ifosfamide, imatinib mesylate, imiquimod, inotuzumab ozogamicin, interferon α-2b recombinant, iobenguane $^{131}$I, ipilimumab, irinotecan hydrochloride, irinotecan hydrochloride liposome, ivosidenib, ixabepilone, ixazomib citrate, JEB, lanreotide acetate, lapatinib ditosylate, larotrectinib sulfate, lenalidomide, lenvatinib mesylate, letrozole, leucovorin calcium, leuprolide acetate, lomustine, lorlatinib, lutetium Lu 177-dotatate, mechlorethamine hydrochloride, megestrol acetate, melphalan, melphalan hydrochloride, mercaptopurine, mesna, methotrexate, methylnaltrexone bromide, midostaurin, mitomycin c, mitoxantrone hydrochloride, mogamulizumab-kpkc, moxetumomab pasudotox-tdfk, MVAC, necitumumab, nelarabine, neratinib maleate, netupitant and palonosetron hydrochloride, nilotinib, nilutamide, niraparib tosylate monohydrate, nivolumab, obinutuzumab, OEPA, ofatumumab, OFF, olaparib, olaratumab, omacetaxine mepesuccinate, ondansetron hydrochloride, OPPA, osimertinib mesylate, oxaliplatin, paclitaxel, paclitaxel albumin-stabilized nanoparticle formulation, PAD, palbociclib, palifermin, palonosetron hydrochloride, palonosetron hydrochloride and netupitant, pamidronate disodium, panitumumab, panobinostat, pazopanib hydrochloride, PCV, PEB, pegaspargase, pegfilgrastim, peginterferon α-2b, pembrolizumab, pemetrexed disodium, pertuzumab, plerixafor, polatuzumab vedotin-piiq, pomalidomide, ponatinib hydrochloride, pralatrexate, prednisone, procarbazine hydrochloride, propranolol hydrochloride, radium 223 dichloride, raloxifene hydrochloride, ramucirumab, rasburicase, ravulizumab-cwvz, R-CHOP, R-CVP, recombinant HPV bivalent vaccine, recombinant HPV nonavalent vaccine, recombinant HPV quadrivalent vaccine, recombinant interferon α-2b, regorafenib, R-EPOCH, ribociclib, R-ICE, rituximab, rituximab and hyaluronidase human, rolapitant hydrochloride, romidepsin, romiplostim, rucaparib camsylate, ruxolitinib phosphate, siltuximab, sipuleucel-t, sonidegib, sorafenib tosylate, STANFORD V, sunitinib malate, TAC, tagraxofusp-erzs, talazoparib tosylate, talc, talimogene laherparepvec, tamoxifen citrate, temozolomide, temsirolimus, thalidomide, thioguanine, thiotepa, tisagenlecleucel, tocilizumab, topotecan hydrochloride, toremifene, TPF, trabectedin, trametinib, trastuzumab, trastuzumab and hyaluronidase-oysk, trifluridine and tipiracil hydrochloride, uridine triacetate, VAC, Valrubicin, VAMP, vandetanib, VeIP, vemurafenib, venetoclax, vinblastine sulfate, vincristine sulfate liposome, vinorelbine tartrate, vip, vismodegib, vorinostat, XELIRI, XELOX, Ziv-aflibercept, zoledronic acid, and combinations of any of the foregoing.

The efficacy of administering an IL-2Rβγc binding compound or a pharmaceutical composition thereof for treating cancer may be assessed using in vitro and animal studies and in clinical trials.

The suitability of an IL-2Rβγc binding compound or a pharmaceutical composition thereof in treating cancer may be determined by methods described in the art. For example, screens developed to demonstrate the anti-tumor activity of oncolytic agents are known (Miller, et al., *J Med Chem,* 1977, 20(3), 409-413; Sweeney, et al., *Cancer Res,* 1978, 38(9), 2886-2891; and Weiss and Von Hoff, *Semin Oncol,* 1985, 12(3 Suppl 4), 69-74).

An IL-2Rβγc binding compound or a pharmaceutical composition thereof can be useful in treating inflammatory diseases.

An IL-2Rβγc binding compound or a pharmaceutical composition thereof may be administered to treat an inflammatory disease.

Examples of inflammatory diseases include allergy, Alzheimer's disease, anemia, ankylosing spondylitis, arthritis, atherosclerosis, asthma, autism, arthritis, carpal tunnel syndrome, celiac disease, colitis, Crohn's disease, congestive heart failure, dermatitis, diabetes, diverticulitis, eczema, fibromyalgia, fibrosis, gall bladder disease gastroesophageal reflux disease, Hashimoto's thyroiditis, heart attack, hepatitis, irritable bowel syndrome, kidney failure, lupus, multiple sclerosis, nephritis, neuropathy, pancreatitis, Parkinson's disease, psoriasis, polymyalgia rheumatica, rheumatoid arthritis, scleroderma, stroke, surgical complications, and ulcerative colitis.

An IL-2Rβγc binding compound or a pharmaceutical composition thereof can be useful in treating autoimmune diseases. Autoimmune diseases can be defined as human diseases in which the immune system attacks its own proteins, cells, and/or tissues. A comprehensive listing and review of autoimmune diseases can be found, for example, in *The Autoimmune Diseases*, Rose and Mackay, 2014, Academic Press.

An IL-2Rβγc binding compound or a pharmaceutical composition thereof may be administered to treat an autoimmune disease.

Examples of autoimmune diseases include Addison's disease, agammaglobulinemia, alopecia areata, amyloidosis, ankylosing spondylitis, anti-GBM/anti-TBN nephritis, antiphospholipid syndrome, autoimmune angioedema, autoimmune dysautonomia, autoimmune encephalomyelitis, autoimmune hepatitis, autoimmune inner ear disease, autoimmune myocarditis, autoimmune pancreatitis, autoimmune retinopathy, autoimmune urticaria, axonal and neuronal neuropathy, Balo disease, Behcet's disease, benign mucosal pemphigoid, bullous pemphigoid, Castleman disease, celiac disease, Chagas disease, chronic inflammatory demyelinating polyneuropathy, chronic recurrent multifocal osteomyelitis, Churg-Strauss, cicatricial pemphigoid, Cogan' syndrome, cold agglutinin disease, congenital heart block, Coxcackie myocarditits, CREST syndrome, Crohn's disease, dermatitis herpetiformis, dermatomyositis, Devic's disease, discoid lupus, Dressler's syndrome, endometriosis, eosinophilic esophagitis, eosinophilic fasciitis, erythema nodosum, essential mixed cryoglobulinemia, Evans syndrome, fibromyalgia, fibrosing alveolitis, giant cell arteritis, giant cell myocarditis, glomerulonephritis, Goodpasture's syndrome, granulomatosis with polyangiitis, Graves' disease, Gullain-Barre syndrome, Hashimoto's thyroiditis, hemolytic anemia, Henoch-Schonlein purpura, herpes gestationis or pemphigoid gestationis, hypogammaglobulinemia, IgA nephropathy, IgG4-related sclerosing disease, immune thrombocytopenic purpura, inclusion body myositis, interstitial cystitis, juvenile arthritis, juvenile diabetes, juvenile myositis, Kawasaki disease, Lambert-Eaton syndrome, leukocytoclastic vasculitis, lichen planus, lichen sclerosus, ligneous conjunctivitis, linear IgA disease, lupus, Lyme disease chronic, Meniere's diseases, microscopic polyangiitis, mixed connective tissue disease, Mooren's ulcer, Mucha-Habermann disease, multiple sclerosis, myasthenia gravis, myositis, narcolepsy, neuromyelitis, optica, neutropenia, ocular cicatricial pemphigoid, optic neuritis, palindromic rheumatism, PANDAS, paraneoplastic cerebellar degeneration, paroxysmal nocturnal hemoglobinuria, Parry Romberg syndrome, pars planitis, Parsonnage-Turner syndrome, pemphigus, peripheral neuropathy, perivenous encephalomyelitis, pernicious anemia, POEMS syndrome, polyarteritis nodosa, polyglandular syndromes, polymyalgia rheumatica, polymyositis, postmyocardial infarction syndrome, postpericardiotomy syndrome, primary biliary cirrhosis, primary sclerosing cholangitis, progesterone dermatitis, psoriasis, psoriatic arthritis, pure red cell aplasia, pyoderma gangrenosum, Raynaud's phenomenon, reactive arthritis, reflex sympathetic dystrophy, relapsing polychondritis, restless legs syndrome, retroperitoneal fibrosis, rheumatic fever, rheumatoid arthritis, sarcodosis, Schmidt syndrome, scleritis, scleroderma, Sjogren's syndrome, sperm and testicular autoimmunity, stiff person syndrome, subacute bacterial endocarditis, Susac's syndrome, sympathetic ophthalmia, Takayasu's arteritis, temporal arteritis, thrombocytopenic purpura, Tolosa-Hunt syndrome, transverse myelitis, type 1 diabetes, ulcerative colitis, undifferentiated connective tissue disease, uveitis, vaculitis, vitiligo, and Wegener's granulomatosis.

An IL-2Rβγc binding compound or a pharmaceutical composition thereof can be use to treat autoimmune disorders such as, for example, lupus, graft-versus-host disease, hepatitis C-induced vasculitis, Type I diabetes, multiple sclerosis, spontaneous loss of pregnancy, atopic diseases, and inflammatory bowel diseases.

An IL-2Rβγc binding compound can be administered with one or more additional therapeutic agents for treating an autoimmune disease. An IL-2Rβγc binding compound or a pharmaceutical composition thereof may be administered in conjunction with one or more immunosuppressants including, for example, corticosteroids such as prednisone, budesonide, and prednisolone; Janus kinase inhibitors such as tofacitinib; calcineurin inhibitors such as cyclosporine and tacrolimus; mTOR inhibitors such as sirolimus and everolimus; IMDH inhibitors such as azathioprine, leflunomide, and mycophenolate; biologics such as abatacept adalimumab, anakinra, certolizumab, etanercept, golimumab, infliximab, ixekizumab, natalizumab, rituximab, secukinumab, tocilizumab, ustekinumab, and vedolizumab; and monoclonal antibodies such as basiliximab and daclizumab.

An IL-2Rβγc binding compound or a pharmaceutical composition thereof may be administered to a patient to treat a disease associated with the activation, proliferation, metabolism, and/or differentiation of T-cells.

An IL-2Rβγc binding compound or a pharmaceutical composition thereof may be administered to a patient to treat an organ transplant.

An IL-2Rβγc binding compound or a pharmaceutical composition thereof may be administered in conjunction with an agent known or believed to interfere with proliferation, to interfere with mitosis, to interfere with DNA replication, or to interfere with DNA repair.

An IL-2Rβγc binding compound or a pharmaceutical composition thereof may be administered to a patient to treat an immune deficiency disease.

Examples of primary immune deficiency disease include autoimmune lymphoproliferative syndrome, autoimmune polyglandular syndrome type 1, BENTA disease, caspase eight deficiency state, CARD9 deficiency, chronic granulomatous disease, common variable immunodeficiency, congenital neutropenia syndromes, CTLA4 deficiency, DOCK8 deficiency, GATA2 deficiency, glycosylation disorders, hyper-immunoglobulin E syndromes, hyper-immunoglobulin M syndromes, interferon γ, interleukin 12 and interleukin 23 deficiency, leukocyte adhesion deficiency, LRBA deficiency, PI2 kinase disease, PLCG2-associated antibody deficiency and immune dysregulation, severe combined immunodeficiency, STAT3 dominant-negative disease, STAT3 gain-of-function disease, warts, hypogammaglobulinemia, infections, and myelokathexis syndrome, Wiskott-Aldrich syndrome, X-linked agammaglobulinemia, X-linked lymphoproliferative disease, and XMEN disease.

Secondary immune deficiency disease occurs when the immune system is compromised to an environmental factor such as infection, chemotherapy, severe burns, or malnutrition. Examples of secondary immune deficiency diseases include newborn immunodeficiencies such as immature lymphoid organs, absent memory immunity, low maternal IgG levels, decreased neutrophil storage pool, decreased neutrophil function, and decreased natural killer cell activity; advanced age related immunodeficiencies such as decreased antigen-specific cellular immunity, T-cell oligoconality, and restricted B-cell repertoire; malnutrition related immunodeficiencies such as decreased cellular immune response and weekend mucosal barriers; diabetes mellitus related immunodeficiencies such as decreased mitogen-induced lymphoproliferation, defective phagocytosis, and decreased chemotaxis; chronic uremia related immunodeficiencies such as decreased cellular immune response, decreased generation of memory antibody responses, and decreased chemotaxis; genetic syndromes such as defective phagocytosis, defective chemotaxis, and variable defects of antigen-specific immune responses; and anti-inflammatory, immunomodulatory, and immuno-suppressive drug therapy related immune deficiencies such as lymphopenia, decreased cellular immune response and anergy, decreased proinflammatory cytokines, decreased phagocytosis, decreased chemotaxis, neutropenia, and weakened mucosal barriers; environmental conditions such as increased lymphocyte apoptosis, increased secretion of tolerogenic cytokines, cytopenia, decreased cellular immunity and anergy, and stress-induced nonspecific immune activation; and infectious diseases such as T-cell lymphopenia, decreased cellular immune response and anergy, and defective antigen-specific antibody responses.

An IL-2Rβγc binding compound or a pharmaceutical composition thereof may be administered to a patient to increase the immune response in immuno-compromised patients.

An IL-2Rβγc binding compound or a pharmaceutical composition thereof may be administered to a patient to increase the immune response in the patient.

An IL-2Rβγc binding compound or a pharmaceutical composition thereof may be administered to a patient to treat an infectious disease.

Examples of infectious diseases include *Acinetobacter* infections, actinomycosis, African sleeping sickness (African trypanosomiasis), AIDS (acquired immunodeficiency syndrome), amoebiasis, anaplasmosis, angiostrongyliasis, anisakiasis, anthrax, *Arcanobacterium haemolyticum* infection, Argentine hemorrhagic fever, ascariasis, aspergillosis, astrovirus infection, babesiosis, *Bacillus cereus* infection, bacterial meningitis, bacterial pneumonia, bacterial vaginosis, *Bacteroides* infection, balantidiasis, bartonellosis, *Baylisascaris* infection, Bejel, syphilis, yaws, BK virus infection, black piedra, blastocystosis, blastomycosis, Bolivian hemorrhagic fever, botulism (and Infant botulism), Brazilian hemorrhagic fever, brucellosis, bubonic plague, *Burkholderia* infection, buruli ulcer, calicivirus infection (Norovirus and Sapovirus), campylobacteriosis, candidiasis (Moniliasis; Thrush), capillariasis, carrion's disease, cat-scratch disease, cellulitis, Chagas disease (American trypanosomiasis), chancroid, chickenpox, chikungunya, chlamydia, *Chlamydophila pneumoniae* infection (Taiwan acute respiratory agent or TWAR), cholera, chromoblastomycosis, *Chytridiomycosis*, clonorchiasis, *Clostridium difficile* colitis, coccidioidomycosis, Colorado tick fever (CTF), common cold (acute viral rhinopharyngitis; Acute coryza, Coronavirus disease 2019 (COVID-19), Creutzfeldt-Jakob disease (CJD), Crimean-Congo hemorrhagic fever (CCHF), cryptococcosis, cryptosporidiosis, cutaneous larva migrans (CLM), cyclosporiasis, cysticercosis, cytomegalovirus infection, Dengue fever, desmodesmus infection, dientamoebiasis, diphtheria, diphyllobothriasis, dracunculiasis, Ebola hemorrhagic fever, echinococcosis, Ehrlichiosis, enterobiasis (pinworm infection), *Enterococcus* infection, enterovirus infection, epidemic typhus, Epstein-Barr virus infectious mononucleosis (Mono), erythema infectiosum (Fifth disease), fxanthem subitum (Sixth disease), fasciolosis, fasciolopsiasis, fatal familial insomnia (FFI), filariasis, food poisoning by *Clostridium perfringens*, free-living amebic infection, *Fusobacterium* infection, gas gangrene (Clostridial myonecrosis), geotrichosis, Gerstmann-Straussler-Scheinker syndrome (GSS), giardiasis, glanders, gnathostomiasis, gonorrhea, granuloma inguinale (Donovanosis), Group A streptococcal infection, Group B streptococcal infection, *Haemophilus influenzae* infection, hand, foot and mouth disease (HFMD), Hantavirus Pulmonary Syndrome (HPS), Heartland virus disease, *Helicobacter pylori* infection, hemolytic-uremic syndrome (HUS), hemorrhagic fever with renal syndrome (HFRS), Hendra virus infection, Hepatitis A, Hepatitis B, Hepatitis C, Hepatitis D, Hepatitis E, Herpes simplex, histoplasmosis, hookworm infection, human bocavirus infection, human ewingii ehrlichiosis, human granulocytic anaplasmosis (HGA), human metapneumovirus infection, human monocytic ehrlichiosis, human papillomavirus (HPV) infection, human parainfluenza virus infection, hymenolepiasis, influenza (flu), isosporiasis, Kawasaki disease, keratitis, Kingella kingae infection, Kuru, Lassa fever, Legionellosis (Legionnaires' disease), leishmaniasis, leprosy, leptospirosis, listeriosis, Lyme disease (Lyme borreliosis), lymphatic filariasis (elephantiasis), lymphocytic choriomeningitis, malaria, Marburg hemorrhagic fever (MHF), measles, melioidosis (Whitmore's disease), meningitis, meningococcal disease, metagonimiasis, microsporidiosis, Middle East respiratory syndrome (MERS), molluscum contagiosum (MC), monkeypox, mumps, murine typhus (Endemic typhus), mycetoma, *Mycoplasma genitalium* infection, *Mycoplasma* pneumonia, myiasis, neonatal conjunctivitis (Ophthalmia neonatorum), Nipah virus infection, nocardiosis, Norovirus (children and babies), onchocerciasis (River blindness), opisthorchiasis, paracoccidioidomycosis (South American blastomycosis), paragonimiasis, pasteurellosis, pediculosis capitis (Head lice), pediculosis corporis (Body lice), pediculosis pubis (pubic lice, crab lice), pelvic inflammatory disease (PID), pertussis (whooping cough), plague, pneumococcal infection, pneumocystis pneumonia (PCP), pneumonia, poliomyelitis, Pontiac fever, *Prevotella* infection, primary amoebic meningoencephalitis (PAM), progressive multifocal leukoencephalopathy, psittacosis, Q fever, rabies, relapsing fever, respiratory syncytial virus infection, rhinosporidiosis, rhinovirus infection, rickettsial infection, rickettsialpox, Rift Valley fever (RVF), Rocky Mountain spotted fever (RMSF), rotavirus infection, rubella, salmonellosis, SARS (severe acute respiratory syndrome), scabies, scarlet fever, schistosomiasis, sepsis, shigellosis (bacillary dysentery), shingles (Herpes zoster), smallpox (variola), sporotrichosis, staphylococcal food poisoning, staphylococcal infection, strongyloidiasis, subacute sclerosing panencephalitis, taeniasis, tetanus (lockjaw), *Tinea barbae* (barber's itch), *Tinea capitis* (ringworm of the scalp), *Tinea corporis* (ringworm of the body), *Tinea cruris* (Jock itch), *Tinea manum* (ringworm of the hand), *Tinea nigra, Tinea pedis* (athlete's foot), *Tinea unguium* (onychomycosis), *Tinea versicolor* (*Pityriasis versicolor*), toxocariasis (ocular larva migrans (OLM)), toxocariasis (visceral larva migrans (VLM)), toxoplasmosis, trachoma, trichinosis, trichomoniasis, trichuriasis (whipworm infection), tuberculosis, tularemia, typhoid fever, typhus fever, *Ureaplasma urealyticum* infection, valley fever, Venezuelan equine encephalitis, Venezuelan hemorrhagic fever, *Vibrio parahaemolyticus* enteritis, *Vibrio vulnificus* infection, viral pneumonia, West Nile fever, white piedra (*Tinea blanca*), yellow fever, *Yersinia pseudotuberculosis* infection, yersiniosis, zeaspora, Zika fever, and zygomycosis.

An IL-2Rβγc binding compound provided by the present disclosure can be used, either alone or in combination, to treat diseases including acute myeloid leukemia, B-cell lymphoma, chronic myelogenous leukemia, depression, gingival recession, hepatitis C, HIV infections, human papillomavirus, idiopathic CD4 lymphopenia, immunodeficiency secondary to organ transplantation, lipodystrophy, Kaposi sarcoma lymphoma, lymphopenia, mantle cell lymphoma, multiple sclerosis, myelodysplastic syndrome, non-Hodgkin lymphoma, recurrent adult diffuse large cell lymphoma, recurrent follicular lymphoma, rheumatoid arthritis, sepsis, and Type 2 diabetes.

An IL-2Rβγc binding compound provided by the present disclosure can be used to treat cancers such as metastatic breast cancer, breast cancer, colon cancer, bladder cancer, metastatic prostate cancer, stage IV prostate cancer, castration-resistant prostate carcinoma, neuroblastoma, melanoma, kidney cancer, myeloproliferative neoplasm, sarcoma, and neurodermal tumors.

An IL-2Rβγc binding compound provided by the present disclosure can be used in combination with temozolomide to great glioblastoma, with atezolizumab to treat skin cancers such as MCC, C5CC and melanoma, with pembrolizumab to treat triple negative breast cancer, and in combination with CAR-T therapy to treat pediatric acute lymphoblastic leukemia.

An IL-2Rβγc binding compound or a pharmaceutical composition thereof may be administered to a patient together with another compound for treating an inflammatory disease or an autoimmune disease in the patient. The at least one other therapeutic agent may be a different IL-2Rβγc binding compound provided by the present disclosure. An IL-2Rβγc binding compound and the at least one other therapeutic agent may act additively or synergistically. The at least one additional therapeutic agent may be included in the same pharmaceutical composition or vehicle comprising the IL-2Rβγc binding compound or may be in a separate pharmaceutical composition or vehicle. Accordingly, methods provided by the present disclosure further include, in addition to administering an IL-2Rβγc binding compound, administering one or more therapeutic agents effective for treating an inflammatory disease or an autoimmune disease or a different disease, disorder or condition than an inflammatory disease or an autoimmune disease. Methods provided by the present disclosure include administering IL-2Rβγc binding compound and one or more other therapeutic agents provided that the combined administration does not inhibit the therapeutic efficacy of the IL-2Rβγc binding compound and/or does not produce adverse combination effects.

IL-2Rβγc binding compounds provided by the present disclosure can be useful in vitro as tools for understanding the biological role of IL-2, including the evaluation of the many factors thought to influence, and be influenced by, the production of IL-2 and the receptor binding process. The present compounds are also useful in the development of other compounds that bind to and activate the IL-2R, because the present compounds provide useful information concerning the relationship between structure and activity that should facilitate such development.

The IL-2Rβγc binding compounds are also useful as competitive binders in assays to screen for new IL-2 receptor agonists and antagonists. In such assays, IL-2Rβγc binding compounds can be used without modification or can be modified in a variety of ways; for example, by labeling, such as covalently or non-covalently joining a moiety which directly or indirectly provides a detectable signal. In any of these assays, the materials thereto can be labeled either directly or indirectly. Possibilities for direct labeling include label groups such as: radiolabels such as $^{125}$I, enzymes such as peroxidase and alkaline phosphatase, and fluorescent labels capable of monitoring the change in fluorescence intensity, wavelength shift, or fluorescence polarization. Possibilities for indirect labeling include biotinylation of one constituent followed by binding to avidin coupled to one of the above label groups. The compounds may also include spacers or linkers in cases where the compounds are to be attached to a solid support.

Based on their ability to bind to the IL-2R, IL-2Rβγc binding compounds provided by the present disclosure can be used as reagents for detecting IL-2R, for example, on living cells, fixed cells, in biological fluids, in tissue homogenates, in purified, and natural biological materials. For example, by labeling such peptides, one can identify cells expressing the IL-2Rβ and IL-2Rγc subunits. In addition, based on their ability to bind to IL-2R, the IL-2Rβγc binding compounds of the present disclosure can be used, for example, in in situ staining, FACS (fluorescence-activated cell sorting), Western Blotting, and ELISA. In addition, based on their ability to bind to IL-2R, IL-2Rβγc binding compounds provided by the present disclosure can be used in receptor purification, or in purifying cells expressing IL-2R on the cell surface (or inside permeabilized cells).

IL-2Rβγc binding compounds provided by the present disclosure can also be utilized as commercial reagents for various medical research and diagnostic uses. Such uses include, for example, (1) use as a calibration standard for quantitating the activities of candidate IL-2 agonists in a variety of functional assays; (2) use to maintain the proliferation and growth of IL-2-dependent cell lines; (3) use in structural analysis of IL-2R through co-crystallization; (4) use to investigate the mechanism of IL-2 signal transduction/receptor activation; and (5) other research and diagnostic applications where IL-2R is activated or such activation is conveniently calibrated against a known quantity of an IL-2R agonist.

Aspects of the present invention include nucleic acids encoding for the IL-2Rβ ligands, the IL-2Rγc ligands, the IL-2Rβγc ligands, the tandem IL-2Rγc ligands, the IL-2Rβγc ligand constructs, and the IL-2Rβγc binding compounds provided by the present disclosure.

The nucleic acids/isolated polynucleotides encoding the IL-2Rβ ligands, IL-2Rγc ligands, and the IL-2Rβγc binding compounds provided by the present disclosure can be incorporated into expression vectors depending in part on the host cells used to produce the IL-2Rβ ligands, the IL-2Rγc ligands, and the IL-2Rβγc binding compounds. Generally, the nucleic acids can be operably linked to any number of regulatory elements such as, for example, promoters, origin of replication, selectable markers, ribosomal binding sites, and/or inducers. The expression vectors can be extra-chromosomal or integrating vectors.

The nucleic acids and/or expression can be transformed into any number of different types of host cells including mammalian, bacterial, yeast, insect and/or fungal cells, with mammalian cells such as CHO cells.

A nucleic acid encoding an IL-2Rβγc ligand can comprise a first nucleic acid sequence encoding an IL-2Rβ ligand; a second nucleic acid sequence encoding a peptidyl ligand linker; and a third nucleic acid sequence encoding an IL-2Rγc ligand.

A nucleic acid encoding an IL-2Rβγc ligand fusion protein can comprise a first nucleic acid sequence encoding the IL-2Rβγc ligand provided by the present disclosure; and a second nucleic acid sequence encoding a fusion partner. A nucleic acid encoding an IL-2Rβγc ligand fusion protein can comprise a nucleic acid encoding an IL-2Rβγc ligand and the fusion partner. A nucleic acid encoding an IL-2Rβγc ligand fusion protein can further comprise a nucleic acid segment encoding a construct linker and a nucleic acid encoding an IL-2Rβγc ligand fusion protein can comprise a nucleic acid encoding an IL-2Rβγc ligand, the fusion partner, and the construct linker.

The fusion partner can comprise, for example, HSA, an Fc-fragment, an IgG, an antibody directed to a cell-specific antigen, and an antibody directed to a cell-specific receptor.

A nucleic acid encoding an IL-2Rβγc fusion protein can further comprise a nucleic acid encoding a peptidyl linker, where the peptidyl linker is configured to bind the IL-2Rβγc ligand to the fusion partner.

A nucleic acid provided by the present disclosure can encode a fusion protein comprising an IL-2Rβγc ligand, and a linker binding the C-terminus of the IL-2Rβγc ligand to HSA.

A nucleic acid provided by the present disclosure can encode a fusion protein comprising a dimeric Fc-Fragment of IgG1, IgG2, or IgG4, an IL-2Rβγc ligand, and a linker binding the N-terminus of an IL-2Rβγc ligand to the C-terminus of one CH3 domain of the dimeric Fc-fragment.

A nucleic acid provided by the present disclosure can encode a fusion protein comprising a dimeric Fc-Fragment of IgG1, IgG2, or IgG4, two IL-2Rβγc ligands, and a linker binding the N-terminus of each of the two IL-2Rβγc ligands to the C-terminus of each CH3 domain of the dimeric Fc-fragment.

A nucleic acid provided by the present disclosure can encode a fusion protein comprising a heavy chain of an immunoglobulin molecule such as IgG1, IgG2, or IgG4, an IL-2Rβγc ligand, and a Fc linker bonding the N-terminus of the IL-2Rβγc ligand to the C-terminus of the Fc region.

A nucleic acid provided by the present disclosure can comprise a nucleic acid encoding for an IL-2Rβγc binding compound provided by the present disclosure and an RNA and/or DNA vaccine.

A nucleic acid provided by the present disclosure can comprise a nucleic acid encoding for an IL-2Rβγc binding vaccine construct. The vaccine can comprise, for example, a cancer vaccine or a viral vaccine.

A nucleic acid provided by the present disclosure can comprise a nucleic acid encoding for an IL-2Rβγc binding construct comprising a viral surface antigen.

A nucleic acid provided by the present disclosure can comprise a nucleic acid encoding for an IL-2Rβγc binding construct comprising a virus-like particle.

A nucleic acid provided by the present disclosure can encode for an IL-2Rβ ligand provided by the present disclosure, or can encode for an amino acid sequence comprising an amino acid sequence having greater than 60%, greater than 70%, greater than 80%, greater than 85%, greater than 90%, or greater than 95% sequence similarity to an IL-2Rβ ligand provided by the present disclosure.

A nucleic acid provided by the present disclosure can encode for an IL-2Rβ ligand comprising an amino acid sequence of any one of SEQ ID NOS: 612, 664, 671, 865, 856, 858, 864, 869, 870, 874, 875, and 901, or can encode for an amino acid sequence comprising an amino acid sequence having greater than 60%, greater than 70%, greater than 80%, greater than 85%, greater than 90%, or greater than 95% sequence similarity to any one of SEQ ID NOS: 612, 664, 671, 865, 856, 864, 858, 869, 870, 874, 875, and 901.

A nucleic acid provided by the present disclosure can encode for an IL-2Rγc ligand provided by the present disclosure, or can encode for an amino acid sequence comprising an amino acid sequence having greater than 60%, greater than 70%, greater than 80%, greater than 85%, greater than 90%, or greater than 95% sequence similarity to an IL-2Rγc ligand provided by the present disclosure.

A nucleic acid provided by the present disclosure can encode for an IL-2Rγc ligand comprising an amino acid sequence of any one of SEQ ID NOS: 965, 980, 981, 985, 1024, 1026, and 1028, or can encode for an amino acid sequence comprising an amino acid sequence having greater than 60%, greater than 70%, greater than 80%, greater than 85%, greater than 90%, or greater than 95% sequence similarity to any one of SEQ ID NOS: 965, 980, 981, 985, 1024, 1026, and 1028.

A nucleic acid provided by the present disclosure can encode for an IL-2Rβγc ligand provided by the present disclosure, or can encode for an amino acid sequence comprising an amino acid sequence having greater than 60%, greater than 70%, greater than 80%, greater than 85%, greater than 90%, or greater than 95% sequence similarity to an IL-2Rβγc ligand provided by the present disclosure.

A nucleic acid provided by the present disclosure can encode for an IL-2Rβγc ligand comprising an amino acid sequence of any one of SEQ ID NOS: 1263-1270, or can encode for an amino acid sequence comprising an amino acid sequence having greater than 60%, greater than 70%, greater than 80%, greater than 85%, greater than 90%, or greater than 95% sequence similarity to any one of SEQ ID NOS: 1263-1270.

A nucleic acid provided by the present disclosure can encode for an IL-2Rβγc ligand fusion protein provided by the present disclosure, or can encode for an amino acid sequence comprising an amino acid sequence having greater than 60%, greater than 70%, greater than 80%, greater than 85%, greater than 90%, or greater than 95% sequence similarity to an IL-2Rβγc ligand fusion protein provided by the present disclosure.

A nucleic acid provided by the present disclosure can encode for an IL-2Rβγc ligand fusion protein comprising an amino acid sequence of any one of SEQ ID NOS: 1212-1252, or can encode for an amino acid sequence comprising an amino acid sequence having greater than 60%, greater than 70%, greater than 80%, greater than 85%, greater than 90%, or greater than 95% sequence similarity to any one of SEQ ID NOS: 1212-1252.

A nucleic acid provided by the present disclosure can encode for an IL-2Rβγc ligand construct comprising an IL-2Rβ ligand comprising an amino acid sequence of SEQ ID NO: 865 or an amino acid sequence comprising an amino acid sequence having greater than 60%, greater than 70%, greater than 80%, greater than 85%, greater than 90%, or greater than 95% sequence similarity to SEQ ID NO: 865; and an IL-2Rγc ligand comprising an amino acid sequence of SEQ ID NO: 965 or an amino acid sequence comprising an amino acid sequence having greater than 60%, greater than 70%, greater than 80%, greater than 85%, greater than 90%, or greater than 95% sequence similarity to SEQ ID NO: 965.

A nucleic acid provided by the present disclosure can encode for a tandem IL-2Rβγc ligand comprising two or more IL-2Rβγc ligands provided by the present disclosure.

Aspects of the invention include expression vectors comprising a nucleic acid encoding an IL-2Rβ ligand, an IL-2Rγc ligand, an IL-2Rβγc ligand, a tandem IL-2Rβγc ligand, or an IL-2Rβγc ligand construct provided by the present disclosure.

Aspects of the invention further include a host cell comprising an expression vector comprising a nucleic acid encoding an IL-2Rβ ligand, an IL-2Rγc ligand, an IL-2Rβγc ligand, a tandem IL-2Rβγc ligand, or an IL-2Rβγc ligand construct provided by the present disclosure.

Methods provided by the present disclosure include methods of making an IL-2Rβ ligand, an IL-2Rγc ligand, an IL-2Rβγc ligand, a tandem IL-2Rβγc ligand, or an IL-2Rβγc ligand construct provided by the present disclosure, comprising culturing a host cell, wherein the host cell comprises an expression vector comprising a nucleic acid encoding an IL-2Rβ ligand, an IL-2Rγc ligand, an IL-2Rβγc ligand, a tandem IL-2Rβγc ligand, or an IL-2Rβγc ligand construct provided by the present disclosure, under conditions where the IL-2Rβ ligand, IL-2Rγc ligand, IL-2Rβγc ligand, tandem IL-2Rβγc ligand, or IL-2Rβγc ligand construct is expressed, and recovering the expressed IL-2Rβ ligand, IL-2Rγc ligand, IL-2Rβγc ligand, tandem IL-2Rβγc ligand, or IL-2Rβγc ligand construct.

ASPECTS OF THE INVENTION

The invention is further defined by the following aspects.

Aspect 1. An IL-2Rβγc ligand comprising:

(a) an IL-2Rβ ligand, wherein the IL-2Rβ ligand comprises an amino acid sequence of Formula (1) (SEQ ID NO: 805), Formula (1a) (SEQ ID NO: 806), Formula (1b) (SEQ ID NO: 807), Formula (1c) (SEQ ID NO: 808), or Formula (1d) (SEQ ID NO: 809), or an amino acid sequence having a greater than 60% sequence similarity to an amino acid sequence of Formula (1) (SEQ ID NO: 805), Formula (1a) (SEQ ID NO: 806), Formula (1b) (SEQ ID NO: 807), Formula (1c) (SEQ ID NO: 808), or Formula (1d) (SEQ ID NO: 809):

$$-X^{211}-X^{212}-X^{213}-X^{214}-C-X^{215}-X^{216}-X^{217}-X^{218}-X^{219}- \\ X^{220}-X^{221}-X^{222}-C-X^{223}-X^{224}-X^{225}- \quad (1)$$

$$-X^{212}-X^{213}-X^{214}-C-X^{215}-X^{216}-X^{217}-X^{218}-X^{219}-X^{220}- \\ X^{221}-X^{222}-C-X^{223}-X^{224}- \quad (1a)$$

$$-X^{213}-X^{214}-C-X^{215}-X^{216}-X^{217}-X^{218}-X^{219}-X^{220}-X^{221}- \\ X^{222}-C-X^{223}-X^{224}- \quad (1b)$$

$$-X^{214}-C-X^{215}-X^{216}-X^{217}-X^{218}-X^{219}-X^{220}-X^{221}-X^{222}- \\ C-X^{223}- \quad (1c)$$

$$-C-X^{215}-X^{216}-X^{217}-X^{218}-X^{219}-X^{220}-X^{221}-X^{222}-C- \quad (1d)$$

wherein,
$X^{211}$ is selected from an amino acid;
$X^{212}$ is selected from F, H, W, and Y;
$X^{213}$ is selected from F, H, I, L, M, V, W, and Y;
$X^{214}$ is P;
$X^{215}$ is selected from F, H, W, and Y;
$X^{216}$ is selected from F, I, L, M, V, W, and Y;
$X^{217}$ is A;
$X^{218}$ is selected from K, R, H, N, Q, S, T, and Y;
$X^{219}$ is selected from F, I, L, M, V, W, and Y;
$X^{220}$ is G;
$X^{221}$ is selected from D, E, H, N, Q, S, T, and Y;
$X^{222}$ is L;
$X^{223}$ is D;
$X^{224}$ is selected from F, I, L, M, V, W, and Y; and
$X^{225}$ is selected from D and E;

(b) an IL-2Rγc ligand, wherein the IL-2Rγc ligand comprises an amino acid sequence of Formula (5) (SEQ ID NO: 944), Formula (5a) (SEQ ID NO: 945), Formula (5b) (SEQ ID NO: 946), Formula (5c) (SEQ ID NO: 947), Formula (5d) (SEQ ID NO: 948), or Formula (5e) (SEQ ID NO: 949), or an amino acid sequence having a greater than 60% sequence similarity to an amino acid sequence of Formula (5) (SEQ ID NO: 944), Formula (5a) (SEQ ID NO: 945), Formula (5b) (SEQ ID NO: 946), Formula (5c) (SEQ ID NO: 947), Formula (5d) (SEQ ID NO: 948), or Formula (5e) (SEQ ID NO: 949):

$$-X^{171}-X^{172}-X^{173}-X^{174}-X^{175}-C-X^{176}-X^{177}-X^{178}-X^{179}- \\ X^{180}-X^{181}-X^{182}-X^{183}-C-X^{184}-X^{185}-X^{186}-X^{187}- \\ X^{188}- \quad (5)$$

$$-X^{172}-X^{173}-X^{174}-X^{175}-C-X^{176}-X^{177}-X^{178}-X^{179}-X^{180}- \\ X^{181}-X^{182}-X^{183}-C-X^{184}-X^{185}-X^{186}-X^{187}- \quad (5a)$$

$$-X^{173}-X^{174}-X^{175}-c-X^{176}-X^{177}-X^{178}-X^{179}-X^{180}-X^{181}- \\ X^{182}-X^{183}-C-X^{184}-X^{185}-X^{186}- \quad (5b)$$

$$-X^{174}-X^{175}-C-X^{176}-X^{177}-X^{178}-X^{179}-X^{180}-X^{181}-X^{182}- \\ X^{183}-C-X^{184}-X^{185}- \quad (5c)$$

$$-X^{175}-C-X^{176}-X^{177}-X^{178}-X^{179}-X^{180}-X^{181}-X^{182}-X^{183}- \\ C-X^{184}- \quad (5d)$$

$$-C-X^{76}-X^{177}-X^{178}-X^{179}-X^{180}-X^{181}-X^{182}-X^{183}-C- \quad (5e)$$

wherein,
$X^{171}$ is selected from H, K, and R;
$X^{172}$ is selected from S, T, and Y;
$X^{173}$ is selected from D, E, F, I, L, M, V, W, and Y;
$X^{174}$ is selected from F, I, L, M, V, W, and Y;
$X^{175}$ is selected from D, E, F, I, L, M, V, W, and Y;
$X^{176}$ is selected from D, E, H, N, Q, S, T, and Y;
$X^{177}$ is selected from D and E;
$X^{178}$ is selected from F, H, I, L, M, V, W, and Y;
$X^{179}$ is selected from D, E, H, N, Q, S, T, and Y;
$X^{180}$ is G;
$X^{181}$ is V;
$X^{182}$ is E;
$X^{183}$ is L;
$X^{184}$ is selected from W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E; and (c) an IL-2Rβγc ligand linker binding the IL-2Rβ ligand to the IL-2Rγc ligand.

Aspect 2. The IL-2Rβγc ligand of aspect 1, wherein in an IL-2Rβ ligand of Formula (5)-(5e):
$X^{211}$ is selected from H, K, and R;
$X^{212}$ is W;
$X^{213}$ is Y;
$X^{214}$ is P;
$X^{215}$ is W;
$X^{216}$ is M;
$X^{217}$ is A;
$X^{218}$ is selected N and Q;
$X^{219}$ is selected from L and V;
$X^{220}$ is G;
$X^{221}$ is selected from E, D, and Q;
$X^{22}$ is L;
$X^{223}$ is D;
$X^{224}$ is selected from L and M; and
$X^{225}$ is selected from D and E.

Aspect 3. The IL-2Rβγc ligand of aspect 1, wherein in an IL-2Rβ ligand of Formula (5)-(5e):
$X^{211}$ is selected from A, D, E, G, H, L, M, N, Q, R, S, T, and V;
$X^{212}$ is selected from C, F, W, and Y;
$X^{213}$ is selected from F, H, K, L, N, Q, R, S, W, and Y;
$X^{214}$ is P;
$X^{215}$ is selected from W and Y;

$X^{216}$ is selected from F, I, K, L, M, R, S, T, and V;
$X^{217}$ is A;
$X^{218}$ is selected from D, E, G, H, K, L, N, Q, R, S, and Y;
$X^{219}$ is selected from L, P, and V;
$X^{220}$ is selected from G, H, and W;
$X^{221}$ is selected from D, E, and Q;
$X^{222}$ is selected from L and M;
$X^{223}$ is D;
$X^{224}$ is selected from L, M, Q, and V; and
$X^{225}$ is selected from A, D, E, F, G, H, L, N, Q, T, and V.

Aspect 4. The IL-2Rβγc ligand of aspect 1, wherein in an IL-2Rβ ligand of Formula (5)-(5e):
$X^{211}$ is selected from H an R;
$X^{212}$ is selected from F and W;
$X^{213}$ is selected from F, L, W, and Y;
$X^{214}$ is P;
$X^{215}$ is selected from W and Y;
$X^{216}$ is selected from F, I, L, M, and V;
$X^{217}$ is A;
$X^{218}$ is selected D, E, H, K, N, Q, and R;
$X^{219}$ is selected from L and V;
$X^{220}$ is G;
$X^{221}$ is selected from D, E, and Q;
$X^{222}$ is selected from L and M;
$X^{223}$ is D;
$X^{224}$ is selected L, M, and V; and
$X^{225}$ is selected from D and E.

Aspect 5. The IL-2Rβγc ligand of aspect 1, wherein in an IL-2Rβ ligand of Formula (5)-(5e):
$X^{211}$ is selected from H and R;
$X^{212}$ is W;
$X^{213}$ is Y;
$X^{214}$ is P;
$X^{215}$ is W;
$X^{216}$ is M;
$X^{217}$ is A;
$X^{218}$ is selected from K and R;
$X^{219}$ is L;
$X^{220}$ is G;
$X^{221}$ is selected from E and Q;
$X^{222}$ is L;
$X^{223}$ is D;
$X^{224}$ is L; and
$X^{225}$ is selected from D and E.

Aspect 6. The IL-2Rβγc ligand of any one of aspects 1 to 5, wherein in an IL-2Rγc ligand of Formula (5)-(5e):
$X^{171}$ is selected from H, K, and R;
$X^{172}$ is selected from S, T, and Y;
$X^{173}$ is selected from D and E;
$X^{174}$ is V;
$X^{175}$ is selected from D and E;
$X^{176}$ is selected from E and Q;
$X^{177}$ is selected from D and E;
$X^{178}$ is selected from F, H, W, and Y;
$X^{179}$ is selected from D, E, and Q;
$X^{180}$ is G;
$X^{181}$ is V;
$X^{182}$ is E;
$X^{183}$ is L;
$X^{184}$ is W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

Aspect 7. The IL-2Rβγc ligand of any one of aspects 1 to 5, wherein in an IL-2Rγc ligand of Formula (5)-(5e):
$X^{171}$ is selected from H, K, and R;
$X^{172}$ is selected from S, T, and Y;
$X^{173}$ is selected from F, I, L, M, V, W, and Y;
$X^{174}$ is V;
$X^{175}$ is selected from F, I, L, M, V, W, and Y;
$X^{176}$ is selected from E and Q;
$X^{177}$ is selected from D and E;
$X^{178}$ is selected from F, H, W, and Y;
$X^{179}$ is selected from D, E, and Q;
$X^{180}$ is G;
$X^{181}$ is V;
$X^{182}$ is E;
$X^{183}$ is L;
$X^{184}$ is W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

Aspect 8. The IL-2Rβγc ligand of any one of aspects 1 to 5, wherein in an IL-2Rγc ligand of Formula (5)-(5e):
$X^{171}$ is selected from H, K, and R;
$X^{172}$ is selected from S, T, and Y;
$X^{173}$ is selected from D, E, F, I, L, M, V, W, and Y;
$X^{174}$ is V;
$X^{175}$ is selected from D, E, F, I, L, M, V, W, and Y;
$X^{176}$ is selected from D, E, H, N, Q, S, T, and Y;
$X^{176}$ is selected from E and Q;
$X^{177}$ is selected from D and E;
$X^{178}$ is W;
$X^{179}$ is selected from D, E, and Q;
$X^{180}$ is G;
$X^{181}$ is V;
$X^{182}$ is E;
$X^{183}$ is L;
$X^{184}$ is W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

Aspect 9. The IL-2Rβγc ligand of aspect 1, wherein, (a) the IL-2Rβ ligand comprises an amino acid sequence of Formula (1), Formula (1a), Formula (1b), Formula (1c), or Formula (1d); and (b) the IL-2Rγc ligand comprises an amino acid sequence of Formula (5), Formula (5a), Formula (5b), Formula (5c), Formula (5d), or Formula (5e).

Aspect 10. The IL-2Rβγc ligand of aspect 1, wherein, (a) the IL-2Rβ ligand comprises an amino acid sequence having a greater than 60% sequence similarity to an amino acid sequence of Formula (1), Formula (1a), Formula (1b), Formula (1c), or Formula (1d); and (b) the IL-2Rγc ligand comprises an amino acid sequence having a greater than 60% sequence similarity to an amino acid sequence of Formula (12), Formula (5a), Formula (5b), Formula (5c), Formula (5d), or Formula (5e).

Aspect 11. The IL-2Rβγc ligand of aspect 1, wherein, the IL-2Rβ ligand comprises an amino acid sequence selected from any one of SEQ ID NOS: 805-903; and the IL-2Rγc ligand comprises an amino acid sequence selected from any one of SEQ ID NOS: 944-1028.

Aspect 12. The IL-2Rβγc ligand of aspect 1, wherein, the IL-2Rβ ligand comprises an amino acid sequence selected from any one of SEQ ID NOS: 612, 664, 865, 856, 858, 864, 869, 870, 874, 875, and 901; and the IL-2Rγc ligand comprises an amino acid sequence selected from any one of SEQ ID NOS: 965, 980, 981, 985, 1024, 1026, and 1028.

Aspect 13. The IL-2Rβγc ligand of aspect 1, wherein the IL-2Rβ ligand has greater than 60% amino acid sequence similarity to any one of SEQ ID NO: 805-903.

Aspect 14. The IL-2Rβγc ligand of aspect 1, wherein the IL-2Rγc ligand has greater than 60% amino acid sequence similarity to any one of SEQ ID NO: 944-1028.

Aspect 15. The IL-2Rβγc ligand of aspect 1, wherein, the IL-2Rβ ligand has greater than 60% amino acid sequence similarity to any one of SEQ ID NOS: 612, 664, 865, 856, 858, 864, 869, 870, 874, 875, and 901; and the IL-2Rγc ligand has greater than 60% amino acid sequence similarity to any one of SEQ ID NOS: 965, 980, 981, 985, 1024, 1026, and 1028.

Aspect 16. The IL-2Rβγc ligand of any one of aspects 1 to 15, wherein the IL-2Rβ ligand comprises a disulfide bond between the two cysteines of the IL-2Rβ ligand.

Aspect 17. The IL-2Rβγc ligand of any one of aspects 1 to 15, wherein the IL-2Rγc ligand comprises a disulfide bond between the two cysteines of the IL-2Rβγc ligand.

Aspect 18. The IL-2Rβγc ligand of any one of aspects 1 to 15, wherein the IL-2Rβγc ligand comprises a disulfide bond between a cysteine of the IL-2Rβ ligand and a cysteine of the IL-2Rγc ligand.

Aspect 19. The IL-2Rβγc ligand of any one of aspects 1 to 15, wherein each of the cysteines of the IL-2Rβ ligand are bound to a cysteine of the IL-2Rγc ligand by a disulfide bond.

Aspect 20. The IL-2Rβγc ligand of any one of aspects 1 to 19, wherein the IL-2Rβ ligand is a pH-biased IL-2Rβ ligand and/or the IL-2Rγc ligand is a pH-biased IL-2Rγc ligand.

Aspect 21. The IL-2Rβγc ligand of any one of aspects 1 to 20, wherein the IL-2Rβγc ligand is a pH-biased IL-2Rβγc ligand.

Aspect 22. The IL-2Rβγc ligand of any one of aspects 1 to 21, wherein the IL-2Rβ ligand binds to a specific binding site of the IL-2Rβ subunit, wherein IL-2, an IL-2Rβ ligand comprising an amino acid sequence of SEQ ID NO: 1044, and an IL-2Rγc ligand comprising SEQ ID NO: 224 do not compete with the IL-2Rβ ligand for binding to the specific binding site on the IL-2Rβ subunit.

Aspect 23. The IL-2Rβγc ligand of any one of aspects 1 to 22, wherein, the IL-2Rβ ligand binds to the IL-2Rβ subunit with an $IC_{50}$ of less than 100 μM; and the IL-2Rβ ligand binds to the IL-2Rγc subunit with an $IC_{50}$ of greater than 100 μM.

Aspect 24. The IL-2Rβγc ligand of any one of aspects 1 to 23, wherein the IL-2Rγc ligand binds to a specific binding site of the IL-2Rγc subunit, wherein IL-2, an IL-2Rγc ligand comprising an amino acid sequence of SEQ ID NO: 1032, and an IL-2Rβ ligand comprising SEQ ID NO: 58 do not compete with the IL-2Rγc ligand for binding to the specific binding site on the IL-2Rγc subunit.

Aspect 25. The IL-2Rβγc ligand of any one of aspects 1 to 24, wherein, the IL-2Rγc ligand binds to the IL-2Rγc subunit with an $IC_{50}$ of less than 100 μM; and the IL-2Rγc ligand binds to the IL-2Rβ subunit with an $IC_{50}$ of greater than 100 μM.

Aspect 26. The IL-2Rβγc ligand of any one of aspects 1 to 25, wherein each of the C-terminus and/or the N-terminus of the IL-2Rβ ligand independently comprises from 2 to 10 flanking amino acids.

Aspect 27. The IL-2Rβγc ligand of any one of aspects 1 to 26, wherein each of the C-terminus and/or the N-terminus of the IL-2Rβ ligand independently comprises flanking amino acids selected from -G- (SEQ ID NO: 9390), -GG- (SEQ ID NO: 9400), or -GGRR- (SEQ ID NO: 9402).

Aspect 28. The IL-2Rβγc ligand of any one of aspects 1 to 27, wherein each of the C-terminus and/or the N-terminus of the IL-2Rγc ligand independently comprises from 2 to 10 flanking amino acids.

Aspect 29. The IL-2Rβγc ligand of any one of aspects 1 to 28, wherein each of the C-terminus and/or the N-terminus of the IL-2Rγc ligand independently comprises flanking amino acids selected from -G- (SEQ ID NO: 9390), -GG- (SEQ ID NO: 9400), or -GGRR- (SEQ ID NO: 9402).

Aspect 30. The IL-2Rβγc ligand of any one of aspects 1 to 29, wherein the C-terminus of the IL-2Rβ ligand and the C-terminus of the IL-2Rγc ligand are bound to the IL-2Rβγc ligand linker.

Aspect 31. The IL-2Rβγc ligand of any one of aspects 1 to 29, wherein the C-terminus of the IL-2Rβ ligand and the N-terminus of the IL-2Rγc ligand are bound to the IL-2Rβγc ligand linker.

Aspect 32. The IL-2Rβγc ligand of any one of aspects 1 to 29, wherein the N-terminus of the IL-2Rβ ligand and the C-terminus of the IL-2Rγc ligand are bound to the IL-2Rβγc ligand linker.

Aspect 33. The IL-2Rβγc ligand of any one of aspects 1 to 29, wherein the N-terminus of the IL-2Rβ ligand and the N-terminus of the IL-2Rγc ligand are bound to the IL-2Rβγc ligand linker.

Aspect 34. The IL-2Rβγc ligand of any one of aspects 1 to 33, wherein the IL-2Rβγc ligand linker has a length from 5 Å to 200 Å.

Aspect 35. The IL-2Rβγc ligand of any one of aspects 1 to 34, wherein the IL-2Rβγc ligand linker is configured to facilitate binding of the IL-2Rβγc ligand to IL-2R.

Aspect 36. The IL-2Rβγc ligand of any one of aspects 1 to 35, wherein the IL-2Rβγc ligand linker is configured to activate IL-2R.

Aspect 37. The IL-2Rβγc ligand of any one of aspects 1 to 36, wherein the IL-2Rβγc ligand linker comprises a synthetic IL-2Rβγc ligand linker.

Aspect 38. The IL-2Rβγc ligand of any one of aspects 1 to 36, wherein the synthetic IL-2Rβγc ligand linker comprises a triazole.

Aspect 39. The IL-2Rβγc ligand of any one of aspects 1 to 36, wherein the IL-2Rβγc ligand linker comprises a peptidyl IL-2Rβγc ligand linker.

Aspect 40. The IL-2Rβγc ligand of aspect 37, wherein the peptidyl IL-2Rβγc ligand linker comprises from 2 to 20 amino acids.

Aspect 41. The IL-2Rβγc ligand of aspect 37, wherein the peptidyl IL-2Rβγc ligand linker comprises $(G)_n$ (SEQ ID NO: 9380), $(GS)_n$ (SEQ ID NO: 9381), $(GGS)_n$ (SEQ ID NO: 9382), $(GGGS)_n$ (SEQ ID NO: 9383), or $(GGGGS)_n$ (SEQ ID NO: 9384), wherein n is an integer from 1 to 20.

Aspect 42. The IL-2Rβγc ligand of any one of aspects 1 to 41, wherein the IL-2Rβγc linker comprises a cleavable IL-2Rβγc ligand linker.

Aspect 43. The IL-2Rβγc ligand of aspect 1, wherein the IL-2Rβγc ligand comprises: an IL-2Rβ ligand comprising the amino acid sequence of SEQ ID NO: 865; and an IL-2Rγc ligand comprising an amino acid sequence of SEQ ID NO: 965.

Aspect 44. The IL-2Rβγc ligand of aspect 1, wherein the IL-2Rβγc ligand comprises: an IL-2Rβ ligand comprising an amino acid sequence having greater than 60% sequence similarity to SEQ ID NO: 865; and an IL-2Rγc ligand comprising an amino acid sequence having greater than 60% sequence similarity to SEQ ID NO: 965.

Aspect 45. The IL-2Rβγc ligand of aspect 44, wherein the IL-2Rβγc ligand linker comprises (G)$_n$ (SEQ ID NO: 9380), (GS)$_n$ (SEQ ID NO: 9381), (GGS)$_n$ (SEQ ID NO: 9382), (GGGS)$_n$ (SEQ ID NO: 9383), or (GGGGS)$_n$ (SEQ ID NO: 9384), wherein n is an integer from 1 to 20.

Aspect 46. The IL-2Rβγc ligand of aspect 44, wherein the IL-2Rβγc ligand linker comprises -GGS- (SEQ ID NO: 9392).

Aspect 47. The IL-2Rβγc ligand of aspect 1, wherein the IL-2Rβγc ligand comprises the amino acid sequence of SEQ ID NO: 1263 or an amino acid sequence having greater that 60% sequence similarity to SEQ ID NO: 1263.

Aspect 48. The IL-2Rβγc ligand of aspect 47, wherein the IL-2Rβγc ligand comprises one or more flanking glycines.

Aspect 49. The IL-2Rβγc ligand of aspect 1, wherein the IL-2Rβγc ligand comprises the amino acid sequence of SEQ ID NO: 1264 or an amino acid sequence having greater that 60% sequence similarity to SEQ ID NO: 1264.

Aspect 50. The IL-2Rβγc ligand of aspect 49, wherein, the cysteines of the IL-2Rβ ligand are bound to each other by a disulfide bond; and the cysteines of the IL-2Rγc ligand are bound to each other by a disulfide bond.

Aspect 51. The IL-2Rβγc ligand of aspect 49, wherein the cysteines of the IL-2Rβ ligand are bound to the cysteines of the IL-2Rγc ligand.

Aspect 52. The IL-2Rβγc ligand of any one of aspects 1 to 51, wherein the IL-2Rβγc ligand is a full IL-2R agonist.

Aspect 53. The IL-2Rβγc ligand of any one of aspects 1 to 51, wherein the IL-2Rβγc ligand is a partial IL-2R agonist.

Aspect 54. The IL-2Rβγc ligand of any one of aspects 1 to 53, wherein the IL-2Rβγc ligand is a pH-biased IL-2R agonist.

Aspect 55. The IL-2Rβγc ligand of any one of aspects 1 to 51, wherein the IL-2Rβγc ligand is an IL-2R agonist for the STAT5 phosphorylation, AKT phosphorylation, and ERK1/2 phosphorylation pathways in NK-92 cells and TF-1β cells.

Aspect 56. A tandem IL-2Rβγc ligand, wherein the tandem IL-2Rβγc ligand comprises two or more of the IL-2Rβγc ligands of any one of aspects 1 to 55.

Aspect 57. The tandem IL-2Rβγc ligand of aspect 56, wherein each of the two or more IL-2Rβγc ligands is the same.

Aspect 58. The tandem IL-2Rβγc ligand of any one of aspects 56 to 57, wherein at least one of the two or more IL-2Rβγc ligands is different than another IL-2Rβγc ligand.

Aspect 59. The tandem IL-2Rβγc ligand of any one of aspects 56 to 58, wherein each of the two or more IL-2Rβγc ligands is bound to another IL-2Rβγc ligand through a tandem linker.

Aspect 60. The tandem IL-2Rβγc ligand of any one of aspects 56 to 59, wherein, the C-terminus of a first IL-2Rβγc ligand is bound to the tandem linker; and the N-terminus of a second IL-2Rβγc ligand is bound to the tandem linker.

Aspect 61. The tandem IL-2Rβγc ligand of any one of aspects 56 to 60, wherein the tandem linker comprises a peptidyl tandem linker.

Aspect 62. The tandem IL-2Rβγc ligand of aspect 61, wherein the peptidyl tandem linker comprises from 2 to 20 amino acids.

Aspect 63. The tandem IL-2Rβγc ligand of any one of aspects 61 to 62, wherein the peptidyl tandem linker has a length from 5 Å to 200 Å.

Aspect 64. An IL-2Rβγc ligand construct, wherein the IL-2Rβγc ligand construct comprises one or more of the IL-2Rβγc ligands of any one of aspects 1 to 55 bound to a construct partner.

Aspect 65. The IL-2Rβγc ligand construct of aspect 64, wherein, the IL-2Rβγc ligand construct comprises two or more IL-2Rβγc ligands; and each of the two or more IL-2Rβγc ligands is the same.

Aspect 66. The IL-2Rβγc ligand construct of aspect 64, wherein, the IL-2Rβγc ligand construct comprises two or more IL-2Rβγc ligands; and at least one of the two or more IL-2Rβγc ligands is different than at least one of the other IL-2Rβγc ligand.

Aspect 67. The IL-2Rβγc ligand construct of any one of aspects 64 to 66, further comprising a construct linker, wherein an IL-2Rβγc ligand is bound to the construct partner through the construct linker.

Aspect 68. The IL-2Rβγc ligand construct of aspect 67, wherein the IL-2Rβγc ligand is bound to the construct linker through the C-terminus of the IL-2Rβγc ligand.

Aspect 69. The IL-2Rβγc ligand construct of aspect 67, wherein the IL-2Rβγc ligand is bound to the construct linker through the N-terminus of the IL-2Rβγc ligand.

Aspect 70. The IL-2Rβγc ligand construct of any one of aspects 67 to 69, wherein the construct linker comprises a peptidyl construct linker.

Aspect 71. The IL-2Rβγc ligand construct of aspect 70, wherein the peptidyl construct linker comprises from 2 to 200 amino acids.

Aspect 72. The IL-2Rβγc ligand construct of any one of aspects 70 to 71, wherein the peptidyl construct linker has a length from 5 Å to 200 Å.

Aspect 73. The IL-2Rβγc ligand construct of aspect 70, wherein the peptidyl construct linker comprises (G)$_n$ (SEQ ID NO: 9380), (GS)$_n$ (SEQ ID NO: 9381), (GGS)$_n$ (SEQ ID NO: 9382), (GGGS)$_n$ (SEQ ID NO: 9383), (GGGGS)$_n$ (SEQ ID NO: 9384), or (PA)$_n$ (SEQ ID NO: 9421), wherein n is an integer from 1 to 20.

Aspect 74. The IL-2Rβγc ligand construct of as aspect 67, wherein the construct linker comprises a cleavable construct linker.

Aspect 75. The IL-2Rβγc ligand construct of any one of aspects 64 to 74, wherein, the construct partner comprises a polypeptide; and the IL-2Rβγc ligand is bound to the C-terminus and/or the N-terminus of the polypeptide.

Aspect 76. The IL-2Rβγc ligand construct of any one of aspects 64 to 74, wherein, the construct partner comprises a polypeptide; and the IL-2Rβγc ligand is bound to an amino acid side chain.

Aspect 77. The IL-2Rβγc ligand construct of any one of aspects 64 to 74, wherein, the construct partner comprises a polypeptide; and the IL-2Rβγc ligand is incorporated into the polypeptide.

Aspect 78. The IL-2Rβγc ligand construct of any one of aspects 64 to 77, wherein the construct partner comprises a compound configured to impart a desired pharmacokinetic property to the IL-2Rβγc ligand in the systemic circulation of a patient.

Aspect 79. The IL-2Rβγc ligand construct of any one of aspects 64 to 78, wherein the construct partner comprises a compound configured to impart a desired biodistribution property to the IL-2Rβγc ligand in the body of a patient.

Aspect 80. The IL-2Rβγc ligand construct of any one of aspects 64 to 79, wherein the construct partner is selected from a polymer, a polypeptide, an Fc-fragment, an immunoglobulin fragment, and an antibody.

Aspect 81. The IL-2Rβγc ligand construct of any one of aspects 64 to 79, wherein the construct partner is selected from human serum albumin, a polypeptide, and a polyethylene glycol.

Aspect 82. The IL-2Rβγc ligand construct of any one of aspects 64 to 79, wherein the IL-2Rβγc ligand construct comprises a recombinant fusion protein.

Aspect 83. The IL-2Rβγc ligand construct of any one of aspects 64 to 82, wherein the IL-2Rβγc ligand construct comprises an amino acid sequence selected from any one of SEQ ID NOS: 1212-1252 or an amino acid sequence having greater than 60% sequence similarity to any one of SEQ ID NOS: 1212-1252.

Aspect 84. The IL-2Rβγc ligand construct of any one of aspects 64 to 82, wherein the IL-2Rβγc ligand comprises the amino acid sequence of SEQ ID NO: 1263 or an amino acid sequence having greater than 60% sequence similarity to SEQ ID NO: 1263.

Aspect 85. The IL-2Rβγc ligand construct of any one of aspects 64 to 84, wherein the construct partner comprises an Fc-fragment.

Aspect 86. The IL-2Rβγc ligand construct of aspect 85, wherein the Fc-fragment is derived from IgG1, IgG2, or IgG4, or a mutant of any of the foregoing.

Aspect 87. The IL-2Rβγc ligand construct of any one of aspects 85 to 86, wherein the IL-2Rβγc ligand is bound to a C-terminus of the Fc-fragment.

Aspect 88. The IL-2Rβγc ligand construct of aspect 87, wherein the IL-2Rβγc ligand is bound to a N-terminus of the Fc-fragment.

Aspect 89. The IL-2Rβγc ligand construct of aspect 87, wherein the IL-2Rβγc ligand is bound to the Fc-fragment though an Fc-fragment linker.

Aspect 90. The IL-2Rβγc ligand construct of aspect 89, wherein the Fc-fragment linker comprises a peptidyl Fc-fragment linker.

Aspect 91. The IL-2Rβγc ligand construct of aspect 89, wherein the peptidyl Fc-fragment linker comprises from 2 to 200 amino acids.

Aspect 92. The IL-2Rβγc ligand construct of aspect 89, wherein the peptidyl Fc-fragment linker has a length from 5 Å to 200 Å.

Aspect 93. The IL-2Rβγc ligand construct of aspect 89, wherein the peptidyl Fc-fragment linker comprises $(G)_n$ (SEQ ID NO: 9380), $(GS)_n$ (SEQ ID NO: 9381), $(GGS)_n$ (SEQ ID NO: 9382), $(GGGS)_n$ (SEQ ID NO: 9383), $(GGGGS)_n$ (SEQ ID NO: 9384), or $(PA)_n$ (SEQ ID NO: 9421), wherein n is an integer from 1 to 20.

Aspect 94. The IL-2Rβγc ligand construct of any one of aspects 64 to 84, wherein the construct partner is an immunoglobulin fragment.

Aspect 95. The IL-2Rβγc ligand construct of aspect 94, wherein the immunoglobulin fragment is selected from an IgG1 fragment, an IgG2 fragment, and an IgG4 fragment.

Aspect 96. The IL-2Rβγc ligand construct of aspect 94, wherein the IL-2Rβγc ligand is bound to a C-terminus of the immunoglobulin fragment.

Aspect 97. The IL-2Rβγc ligand construct of aspect 94, wherein the IL-2Rβγc ligand is bound to an N-terminus of the immunoglobulin fragment.

Aspect 98. The IL-2Rβγc ligand construct of aspect 94, wherein the IL-2Rβγc ligand is bound to the immunoglobulin fragment though an immunoglobulin linker.

Aspect 99. The IL-2Rβγc ligand construct of aspect 98, wherein the immunoglobulin linker comprises a peptidyl immunoglobulin linker.

Aspect 100. The IL-2Rβγc ligand construct of aspect 99, wherein the peptidyl immunoglobulin linker comprises from 2 to 200 amino acids.

Aspect 101. The IL-2Rβγc ligand construct of aspect 99, wherein the peptidyl immunoglobulin linker has a length from 5 Å to 200 Å.

Aspect 102. The IL-2Rβγc ligand construct of aspect 99, wherein the peptidyl immunoglobulin linker comprises $((G)_n$ (SEQ ID NO: 9380), $(GS)_n$ (SEQ ID NO: 9381), $(GGS)_n$ (SEQ ID NO: 9382), $(GGGS)_n$ (SEQ ID NO: 9383), $(GGGGS)_n$ (SEQ ID NO: 9384), or $(PA)_n$ (SEQ ID NO: 9421), wherein n is an integer from 1 to 20.

Aspect 103. The IL-2Rβγc ligand construct of aspect 89, wherein at least one IL-2Rβγc ligand is bound to an immunoglobulin heavy chain.

Aspect 104. The IL-2Rβγc ligand construct of aspect 89, wherein at least one IL-2Rβγc ligand is bound to an immunoglobulin light chain.

Aspect 105. The IL-2Rβγc ligand construct of any one of aspects 64 to 84, wherein the construct partner comprises an antibody.

Aspect 106. The IL-2Rβγc ligand construct of aspect 99, wherein the antibody is directed to a tumor antigen.

Aspect 107. The IL-2Rβγc ligand construct of aspect 106, wherein the tumor antigen is selected from CEA and FAP.

Aspect 108. The IL-2Rβγc ligand construct of aspect 105, wherein the antibody is directed to a checkpoint inhibitor.

Aspect 109. The IL-2Rβγc ligand construct of aspect 108, wherein the checkpoint inhibitor is PD-1.

Aspect 110. The IL-2Rβγc ligand construct of aspect 109, wherein in the PD-1 antibody is selected from cemiplimab and pembrolizumab.

Aspect 111. The IL-2Rβγc ligand construct of aspect 105, wherein the antibody is directed to a cell-specific antigen.

Aspect 112. The IL-2Rβγc ligand construct of aspect 111, wherein the cell-specific antigen is selected from CD25, NK62D, and CD8.

Aspect 113. The IL-2Rβγc ligand construct of aspect 105, wherein the antibody further comprises a cytokine.

Aspect 114. The IL-2Rβγc ligand construct of aspect 113, wherein the cytokine comprises an interleukin.

Aspect 115. The IL-2Rβγc ligand construct of any one of aspects 64 to 84, wherein the IL-2Rβγc ligand construct comprises a cell-targeting moiety.

Aspect 116. The IL-2Rβγc ligand construct of aspect 115, wherein the cell-targeting moiety comprises a tumor targeting moiety.

Aspect 117. The IL-2Rβγc ligand construct of aspect 115, wherein the cell-targeting moiety comprises an immune cell targeting moiety.

Aspect 118. The IL-2Rβγc ligand construct of any one of aspects 64 to 84, wherein the IL-2Rβγc ligand construct further comprises a ubiquitin-like modifier.

Aspect 119. The IL-2Rβγc ligand construct of any one of aspects 64 to 118, wherein the IL-2Rβγc ligand construct further comprises a therapeutically effective moiety in addition to the IL-2Rβγc ligand.

Aspect 120. The IL-2Rβγc ligand construct of any one of aspects 64 to 119, wherein the IL-2Rβγc ligand construct is a full IL-2R agonist.

Aspect 121. The IL-2Rβγc ligand construct of any one of aspects 64 to 119, wherein the IL-2Rβγc ligand construct is a partial IL-2R agonist.

Aspect 122. The IL-2Rβγc ligand construct of any one of aspects 64 to 121, wherein the IL-2Rβγc ligand construct is a pH-biased IL-2R agonist.

Aspect 123. An IL-2Rβγc ligand construct, wherein the IL-2Rβγc ligand construct comprises a construct partner, at least one IL-2Rβ ligand bound to the construct partner, and at least one IL-2Rγc ligand bound to the construct partner, wherein, (a) the IL-2Rβ ligand comprises an amino acid sequence of Formula (11) (SEQ ID NO: 805), Formula (11a) (SEQ ID NO: 806), Formula (11b) (SEQ ID NO: 807), Formula (11c) (SEQ ID NO: 808), or Formula (11d) (SEQ ID NO: 809), or an amino acid sequence having a greater than 60% sequence similarity to an amino acid sequence of Formula (11) (SEQ ID NO: 805), Formula (11a) (SEQ ID NO: 806), Formula (11b) (SEQ ID NO: 807), Formula (11c) (SEQ ID NO: 808), or Formula (11d) (SEQ ID NO: 809):

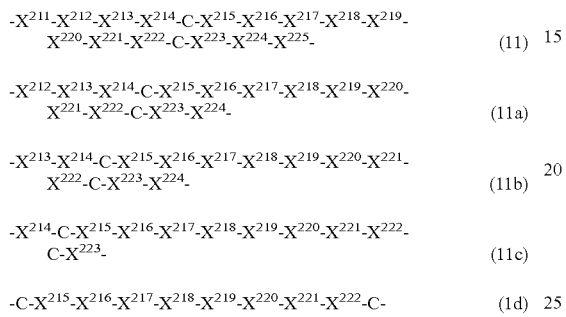

wherein,
$X^{211}$ is selected from an amino acid;
$X^{212}$ is selected from F, H, W, and Y;
$X^{213}$ is selected from F, H, I, L, M, V, W, and Y;
$X^{214}$ is P;
$X^{215}$ is selected from F, H, W, and Y;
$X^{216}$ is selected from F, I, L, M, V, W, and Y;
$X^{217}$ is A;
$X^{218}$ is selected from K, R, H, N, Q, S, T, and Y;
$X^{219}$ is selected from F, I, L, M, V, W, and Y;
$X^{220}$ is G;
$X^{221}$ is selected from D, E, H, N, Q, S, T, and Y;
$X^{222}$ is L;
$X^{223}$ is D;
$X^{224}$ is selected from F, I, L, M, V, W, and Y; and
$X^{225}$ is selected from D and E; and (b) the IL-2Rγc ligand comprises an amino acid sequence of Formula (5) (SEQ ID NO: 944), Formula (5a) (SEQ ID NO: 945), Formula (5b) (SEQ ID NO: 946), Formula (5c) (SEQ ID NO: 947), Formula (5d) (SEQ ID NO: 948), or Formula (5e) (SEQ ID NO: 1949), or an amino acid sequence having a greater than 60% sequence similarity to an amino acid sequence of Formula (5) (SEQ ID NO: 944), Formula (5a) (SEQ ID NO: 945), Formula (5b) (SEQ ID NO: 946), Formula (5c) (SEQ ID NO: 947), Formula (5d) (SEQ ID NO: 948), or Formula (5e) (SEQ ID NO: 949):

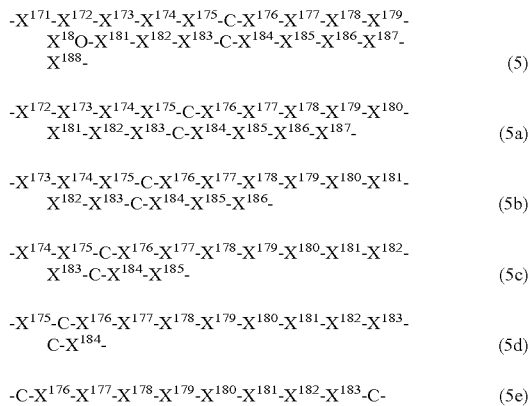

wherein,
$X^{171}$ is selected from H, K, and R;
$X^{172}$ is selected from S, T, and Y;
$X^{173}$ is selected from D, E, F, I, L, M, V, W, and Y;
$X^{174}$ is selected from F, I, L, M, V, W, and Y;
$X^{175}$ is selected from D, E, F, I, L, M, V, W, and Y;
$X^{176}$ is selected from D, E, H, N, Q, S, T, and Y;
$X^{177}$ is selected from D and E;
$X^{178}$ is selected from F, H, I, L, M, V, W, and Y;
$X^{179}$ is selected from D, E, H, N, Q, S, T, and Y;
$X^{180}$ is G;
$X^{181}$ is V;
$X^{182}$ is E;
$X^{183}$ is L;
$X^{184}$ is selected from W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

Aspect 124. The IL-2Rβγc ligand of aspect 123, wherein, the IL-2Rβ ligand comprises the amino acid sequence of SEQ ID NO: 865, or an amino acid sequence having a greater than 60% sequence similarity to SEQ ID NO: 865; and the IL-2Rγc ligand comprises the amino acid sequence of SEQ ID NO: 965, or an amino acid sequence having a greater than 60% sequence similarity to SEQ ID NO: 965.

Aspect 125. The IL-2Rβγc ligand of any one of aspects 123 to 124, wherein, the cysteines of the IL-2Rβ ligand are bound to each other by a disulfide bond; and the cysteines of the IL-2Rγc ligand are bound to each other by a disulfide bond.

Aspect 126. The IL-2Rβγc ligand construct of any one of aspects 123 to 125, wherein each of the at least one IL-2Rβ ligands and each of the at least one IL-2Rγc ligands are bound to the construct partner through a construct linker.

Aspect 127. The IL-2Rβγc ligand construct of any one of aspects 123 to 126, wherein each of the at least one IL-2Rβ ligands is the same, and each of the at least one IL-2Rγc ligands is the same.

Aspect 128. The IL-2Rβγc ligand construct of any one of aspects 123 to 127, wherein at least one of the IL-2Rβ ligands is different than at least one of the other IL-2Rβ ligands and/or at least one of the IL-2Rγc ligands is different than at least one of the other IL-2Rγc ligands.

Aspect 129. The IL-2Rβγc ligand construct of any one of aspects 123 to 128, wherein the construct partner comprises an Fc fragment, an immunoglobulin fragment, or an immunoglobulin.

Aspect 130. The IL-2Rβγc ligand construct of any one of aspects 123 to 128, wherein the construct partner comprises a polypeptide or a polymer.

Aspect 131. The IL-2Rβγc ligand construct of any one of aspects 123 to 130, further comprising at least one IL-2Rβγc ligand.

Aspect 132. A method of treating cancer in a patient comprising administering to a patient in need of such treatment a therapeutically effective amount of the IL-2Rβγc ligand of any one of aspects 1 to 155, the tandem IL-2Rβγc ligand of any one of aspects 56 to 63, the IL-2Rβγc ligand construct of any one of aspects 64 to 122, the IL-2Rβγc ligand construct of any one of aspects 123 to 131, or a combination of any of the foregoing.

Aspect 133. A method of treating an autoimmune disease in a patient comprising administering to a patient in need of such treatment a therapeutically effective amount of the IL-2Rβγc ligand of any one of aspects 1 to 155, the tandem IL-2Rβγc ligand of any one of aspects 56 to 63, the IL-2Rβγc ligand construct of any one of aspects 64 to 122, the IL-2Rβγc ligand construct of any one of aspects 123 to 131, or a combination of any of the foregoing.

Aspect 134. A method of treating an inflammatory disease in a patient comprising administering to a patient in need of such treatment a therapeutically effective amount of the IL-2Rβγc ligand of any one of aspects 1 to 155, the tandem IL-2Rβγc ligand of any one of aspects 56 to 63, the IL-2Rβγc ligand construct of any one of aspects 64 to 122, the IL-2Rβγc ligand construct of any one of aspects 123 to 131, or a combination of any of the foregoing.

Aspect 135. A method of expanding immune cells comprising contacting a population of immune cells ex vivo or in vivo with an effective amount of the IL-2Rβγc ligand of any one of aspects 1 to 155, the tandem IL-2Rβγc ligand of any one of aspects 56 to 63, the IL-2Rβγc ligand construct of any one of aspects 64 to 122, the IL-2Rβγc ligand construct of any one of aspects 123 to 131, or a combination of any of the foregoing.

Aspect 136. A method of cell therapy comprising engineering a cell to express the IL-2Rβγc ligand of any one of aspects 1 to 155 or the tandem IL-2Rβγc ligand of any one of aspects 56 to 63, such that the IL-2Rβγc ligand or tandem IL-2Rβγc ligand is express on the cell surface and/or secreted by the cell.

Aspect 137. A method of boosting a vaccine comprising administering to a patient a vaccine and a therapeutically effective amount of the IL-2Rβγc ligand of any one of aspects 1 to 155, the tandem IL-2Rβγc ligand of any one of aspects 56 to 63, the IL-2Rβγc ligand construct of any one of aspects 64 to 122, the IL-2Rβγc ligand construct of any one of aspects 123 to 131, or a combination of any of the foregoing.

Aspect 138. A method of modifying the immune response comprising administering to a patient an effective amount of the IL-2Rβγc ligand of any one of aspects 1 to 155, the tandem IL-2Rβγc ligand of any one of aspects 56 to 63, the IL-2Rβγc ligand construct of any one of aspects 64 to 122, the IL-2Rβγc ligand construct of any one of aspects 123 to 131, or a combination of any of the foregoing.

Aspect 139. A pharmaceutical composition comprising the IL-2Rβγc ligand of any one of aspects 1 to 155, the tandem IL-2Rβγc ligand of any one of aspects 56 to 63, the IL-2Rβγc ligand construct of any one of aspects 64 to 122, the IL-2Rβγc ligand construct of any one of aspects 123 to 131, or a combination of any of the foregoing.

Aspect 140. The pharmaceutical composition of aspect 139, further comprising a chemotherapeutic agent, an immunomodulator, a checkpoint inhibitor, a vaccine, or a combination of any of the foregoing.

Aspect 141. A nucleic acid encoding for the IL-2Rβγc ligand of any one of aspects 1 to 155, the tandem IL-2Rβγc ligand of any one of aspects 56 to 63, the IL-2Rβγc ligand construct of any one of aspects 64 to 122, and/or the IL-2Rβγc ligand construct of any one of aspects 123 to 131.

Aspect 142. A nucleic acid encoding for an IL-2Rβ ligand, wherein the IL-2Rβ ligand comprises an amino acid sequence selected from of any one of SEQ ID NOS: 805-903, or an amino acid sequence having greater than 60% amino acid sequence similarity to any one of SEQ ID NOS: 805-903.

Aspect 143. A nucleic acid encoding for an IL-2Rβ ligand, wherein the IL-2Rβ ligand comprises an amino acid sequence selected from any one of SEQ ID NOS: 612, 664, 865, 856, 858, 864, 869, 870, 874, 875, and 901, or an amino acid sequence having greater than 60% amino acid sequence similarity to any one of SEQ ID NOS: 612, 664, 865, 856, 858, 864, 869, 870, 874, 875, and 901.

Aspect 144. A nucleic acid encoding for the IL-2Rγc ligand, wherein the IL-2Rγc ligand comprises an amino acid sequence selected from any one of SEQ ID NOS: 944-1028, or an amino acid sequence having greater than 60% amino acid sequence similarity to any one of SEQ ID NOS: 944-1028.

Aspect 145. A nucleic acid encoding for the IL-2Rγc ligand, wherein the IL-2Rγc ligand comprises an amino acid sequence selected from any one of SEQ ID NOS: 965, 980, 981, 985, 1024, and 1026, or an amino acid sequence having greater than 60% amino acid sequence similarity to any one of SEQ ID NOS: 965, 980, 981, 985, 1024, 1026, and 1028.

Aspect 146. A nucleic acid encoding for the IL-2Rβγc ligand of any one of aspects 1 to 155.

Aspect 147. The nucleic acid of aspect 146, wherein the IL-2Rβγc ligand comprises: an IL-2Rβ ligand comprising the amino acid sequence of SEQ ID NO: 865, or an amino acid sequence having greater than 60% amino acid sequence similarity to SEQ ID NO: 865; and an IL-2Rγc ligand comprising the amino acid sequence of SEQ ID NO: 965, or an amino acid sequence having greater than 60% amino acid sequence similarity to SEQ ID NO: 865.

Aspect 148. The nucleic acid of aspect 146, wherein the IL-2Rβγc ligand comprises an amino acid sequence comprising SEQ ID NO: 1205, or an amino acid sequence having greater than 60% amino acid sequence similarity to SEQ ID NO: 1205.

Aspect 149. A nucleic acid encoding for the tandem IL-2Rβγc ligand of any one of aspects 56 to 63, wherein, each of the IL-2Rβγc ligand linkers independently comprises a peptidyl IL-2Rβγc ligand linker; and each of the tandem linkers independently comprises a peptidyl tandem linker.

Aspect 150. A nucleic acid encoding for the IL-2Rβγc ligand construct of any one of aspects 64 to 122, wherein the construct linker comprises a peptidyl construct linker.

Aspect 151. A nucleic acid encoding for the IL-2Rβγc ligand construct of aspect 150, wherein the IL-2Rβγc ligand construct comprises an amino acid sequence having greater than 60% amino acid sequence similarity to any one of SEQ ID NOS: 1202-1252.

Aspect 152. A nucleic acid encoding for the IL-2Rβγc ligand construct, wherein the IL-2Rβγc ligand construct comprises an amino acid sequence selected from of any one of SEQ ID NOS: 1202-1252.

Aspect 153. A nucleic acid encoding for the IL-2Rβγc ligand construct of any one of aspects 123 to 131.

Aspect 1A. An IL-2Rβ ligand, wherein the IL-2Rβ ligand comprises an amino acid sequence of any one of Formula (1)-(1d), Formula (2)-(2d), Formula (3)-(3e), and Formula (4)-(4f), a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 2A. An IL-2Rβ ligand, wherein the IL-2Rβ ligand comprises an amino acid sequence of any one of SEQ ID NOS: 805-903, 911-930, 2575-2655, 2661-2891, 2900-2926, and 2929-2939, a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 3A. An IL-2Rβ ligand, wherein the IL-2Rβ ligand comprises an amino acid sequence of any one of Formula (1)-(1d), Formula (2)-(2d), Formula (3)-(3e), or Formula (4)-(4f).

Aspect 4A. An IL-2Rβ ligand, wherein the IL-2Rβ ligand comprises an amino acid sequence of any one of SEQ ID NOS: 805-903, 911-930, 2575-2655, 2661-2891, 2900-2926, or 2929-2939.

Aspect 5A. An IL-2Rβ ligand, wherein the IL-2Rβ ligand comprises an amino acid sequence of SEQ ID NO: 865, a truncated amino acid sequence thereof, a substituted amino acid sequence of any of the foregoing, any of the foregoing amino acid sequences having flanking amino acids, and an amino acid sequence having greater than 60% sequence similarity to any of the foregoing.

Aspect 6A. The IL-2Rβ ligand of any one of aspects 1A to 5A, wherein the IL-2Rβ ligand comprises a disulfide bond between the two cysteines of the IL-2Rβ ligand.

Aspect 7A. The IL-2Rβ ligand of any one of aspects 1A to 6A, wherein the IL-2Rβ ligand binds to the specific binding site of the IL-2Rβ subunit with an IC50 less than 100 μM as determined using phage ELISA competition assays.

Aspect 8A. The IL-2Rβ ligand of any one of aspects 1A to 7A, wherein the IL-2Rβ ligand exhibits an $EC_{50}$ for STAT5 phosphorylation in TF-1β cells and/or NK-92 cells of less than 100 μM.

Aspect 9A. The IL-2Rβ ligand of any one of aspects 1A to 8A, wherein the IL-2Rβ ligand binds to the hIL-2Rβ subunit with an IC50 less than 100 μM as determined using phage ELISA competition assays.

Aspect 10A. The IL-2Rβ ligand of any one of aspects 1A to 9A, wherein the IL-2Rβ ligand binds to the cyno-IL-2Rβ subunit with an IC50 less than 100 μM as determined using phage ELISA competition assays.

Aspect 11A. An IL-2Rγc ligand, wherein the IL-2Rγc ligand comprises an amino acid sequence of any one of Formula (5)-(5e); a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 12A. An IL-2Rγc ligand, wherein the IL-2Rγc ligand comprises an amino acid sequence of any one of SEQ ID NOS: 944-1028, 1032-1060, and 1601-1613; a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 13A. An IL-2Rγc ligand, wherein the IL-2Rγc ligand comprises an amino acid sequence of any one of Formula (5)-(5e).

Aspect 14A. An IL-2Rγc ligand, wherein the IL-2Rγc ligand comprises an amino acid sequence of any one of SEQ ID NOS: 944-1028, 1032-1060, and 1601-1613.

Aspect 15A. An IL-2Rγc ligand, wherein the IL-2Rγc ligand comprises an amino acid sequence of SEQ ID NO: 965, a truncated amino acid sequence thereof, a substituted amino acid sequence of any of the foregoing, any of the foregoing amino acid sequences having flanking amino acids, and an amino acid sequence having greater than 60% sequence similarity to any of the foregoing.

Aspect 16A. The IL-2Rγc ligand of any one of aspects 11A to 15A, wherein the IL-2Rγc ligand comprises a disulfide bond between the two cysteines of the IL-2Rγc ligand.

Aspect 17A. The IL-2Rγc ligand of any one of aspects 11A to 16A, wherein the IL-2Rγc ligand binds to the specific binding site of the IL-2Rγc subunit with an IC50 less than 100 μM as determined using phage ELISA competition assays.

Aspect 18A. The IL-2Rγc ligand of any one of aspects 11A to 17A, wherein the IL-2Rγc ligand exhibits an EC50 for STAT5 phosphorylation in TF-1β cells and/or NK-92 cells of less than 100 μM.

Aspect 19A. The IL-2Rγc ligand of any one of aspects 11A to 18A, wherein the IL-2Rγc ligand binds to the hIL-2Rγc subunit with an IC50 less than 100 μM as determined using phage ELISA competition assays.

Aspect 20A. The IL-2Rγc ligand of any one of aspects 11A to 19A, wherein the IL-2Rγc ligand binds to the cyno-IL-2Rγc subunit with an IC50 less than 100 μM as determined using phage ELISA competition assays.

Aspect 21A. An IL-2Rβγc binding compound wherein the IL-2Rβγc binding compound comprises: the IL-2Rβ ligand of any one of aspects 1A to 10A; and the IL-2Rγc ligand of any one of aspects 11A to 20A.

Aspect 22A. The IL-2Rβγc binding compound of aspect 21A, wherein the IL-2Rβγc binding compound comprises an IL-2Rβγc ligand, wherein the 2Rβγc ligand comprises: a ligand linker; the IL-2Rβ ligand bound to the ligand linker; and the IL-2Rγc ligand bound to the ligand linker.

Aspect 23A. The IL-2Rβγc binding compound of aspect 22A, wherein the IL-2Rβγc ligand comprises a disulfide bond between two cysteines of the IL-2Rβγc ligand.

Aspect 24A. The IL-2Rβγc binding compound of any one of aspects 21A to 22A, wherein the IL-2Rβ ligand and the IL-2Rγc ligand are bonded to the ligand linker in an C/C orientation, an C/N orientation, an N/C orientation, or an N/N orientation.

Aspect 25A. The IL-2Rβγc binding compound of any one of aspects 21A to 24A, wherein the ligand linker comprises a peptidyl ligand linker.

Aspect 26A. The IL-2Rβγc binding compound of any one of aspects 21A to 24A, wherein the ligand linker comprises a chemical ligand linker.

Aspect 27A. The IL-2Rβγc binding compound of any one of aspects 21A to 24A, wherein the ligand linker comprises (G)$_n$ (SEQ ID NO: 9380), (GS)$_n$ (SEQ ID NO: 9381), (GGS)$_n$ (SEQ ID NO: 9382). (GGGS)$_n$ (SEQ ID NO: 9383), or (GGGGS)$_n$ (SEQ ID NO: 9384), wherein n is an integer from 1 to 20.

Aspect 28.A The IL-2Rβγc binding compound of any one of aspects 21A to 24A, wherein the IL-2Rβγc ligand comprises an amino acid sequence of any one of SEQ ID NOS: 1263-1270, 4070-4085, and 4090 to 4099, a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 29A. The IL-2Rβγc binding compound of any one of aspects 21A to 24A, wherein the IL-2Rβγc ligand comprises an amino acid sequence of any one of SEQ ID NOS: 1263-1270, 4070-4085, and 4090 to 4099.

Aspect 30A. The IL-2Rβγc binding compound of any one of aspects 21A to 29A, wherein the IL-2Rβγc ligand is a full IL-2R agonist or a partial IL-2R agonist.

Aspect 31A. The IL-2Rβγc binding compound of any one of aspects 21A to 30A, wherein the IL-2Rβγc ligand exhibits an $EC_{50}$ for STAT5 phosphorylation in TF-1β cells and/or NK-92 cells of less than 100 μM.

Aspect 32A. The IL-2Rβγc binding compound of any one of aspects 21A to 31A, wherein the IL-2Rβγc ligand binds to hIL-2R with an IC50 less than 100 μM as determined using phage ELISA competition assays.

Aspect 33A. The IL-2Rβγc binding compound of any one of aspects 21A to 32A, wherein the IL-2Rβγc ligand binds to cyno-IL-2R with an IC50 less than 100 μM as determined using phage ELISA competition assays.

Aspect 34A. The IL-2Rβγc binding compound of aspect 21A, wherein the IL-2Rβγc binding compound comprises a construct partner, wherein the IL-2Rβ ligand and the IL-2Rγc ligand are bound to the construct partner.

Aspect 35A. The IL-2Rβγc binding compound of any one of aspects 22A to 33A, wherein the IL-2Rβγc binding compound comprises the IL-2Rβγc ligand, and the IL-2Rβγc ligand is bound to the construct partner.

Aspect 36A. The IL-2Rβγc binding compound of aspect 35A, wherein the IL-2Rβγc ligand is bonded to the construct partner through the C-terminus or through the N-terminus of the IL-2Rβγc ligand.

Aspect 37A. The IL-2Rβγc binding compound of any one of aspects 35A to 36A, wherein in the IL-2Rβγc ligand is bound to the construct partner through a construct linker.

Aspect 38A. The IL-2Rβγc binding compound of aspect 37A, wherein the construct linker comprises a peptidyl ligand linker.

Aspect 39A. The IL-2Rβγc binding compound of aspect 37A, wherein the construct linker comprises a chemical ligand linker.

Aspect 40A. The IL-2Rβγc binding compound of aspect 37A, wherein the construct linker comprises $(G)_n$ (SEQ ID NO: 9380), $(GS)_n$ (SEQ ID NO: 9381), $(GGS)_n$ (SEQ ID NO: 9382). $(GGGS)_n$ (SEQ ID NO: 9383), or $(GGGGS)_n$ (SEQ ID NO: 9384), wherein n is an integer from 1 to 20.

Aspect 41A. The IL-2Rβγc binding compound of any one of aspects 34A to 40A, wherein the construct partner is selected from a polymer, a polypeptide, an Fc-fragment, an immunoglobulin fragment, and an antibody.

Aspect 42A. The IL-2Rβγc binding compound of any one of aspects 34A to 40A, wherein the construct partner is selected from human serum albumin, a polypeptide, and a polyethylene glycol.

Aspect 43A. The IL-2Rβγc binding compound of any one of aspects 34A to 40A, wherein the construct partner comprises a viral surface antigen or a virus-like particle.

Aspect 44A. The IL-2Rβγc binding compound of any one of aspects 34A to 40A, wherein the construct partner comprises a cytokine.

Aspect 45A. The IL-2Rβγc binding compound of any one of aspects 34A to 40A, wherein the compound comprises a recombinant fusion protein.

Aspect 46A. The IL-2Rβγc binding compound of aspect 45A, wherein the recombinant fusion protein is selected from a hIgG-Fc recombinant fusion protein and a hIgG1-Fc recombinant fusion protein.

Aspect 47A. The IL-2Rβγc binding compound of any one of aspects 34A to 40A, wherein the construct partner comprises an antibody and the antibody is directed to a tumor antigen.

Aspect 48A. The IL-2Rβγc binding compound of any one of aspects 34A to 40A, wherein the construct partner comprises a cell-targeting moiety.

Aspect 49A. The IL-2Rβγc binding compound of aspect 48A, wherein cell-targeting moiety comprises a tumor-targeting moiety, an immune cell-targeting moiety, or a combination thereof.

Aspect 50A. The IL-2Rβγc binding compound of aspect 35A, wherein the IL-2Rβγc binding compound comprises an amino acid sequence of any one of SEQ ID NOS: 1212-1252 and 8061-8082, a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 51A. The IL-2Rβγc binding compound of any one of aspects 34A to 50A, wherein the IL-2Rβγc binding compound is a full IL-2R agonist or a partial IL-2R agonist.

Aspect 52A. The IL-2Rβγc binding compound of any one of aspects 34A to 51A, wherein the IL-2Rβγc binding compound exhibits an $EC_{50}$ for STAT5 phosphorylation in TF-1β cells and/or NK-92 cells of less than 100 μM.

Aspect 53A. The IL-2Rβγc binding compound of any one of aspects 34A to 52A, wherein the IL-2Rβγc binding compound binds to hIL-2R with an IC50 less than 100 μM as determined using phage ELISA competition assays.

Aspect 54A. The IL-2Rβγc binding compound of any one of aspects 34A to 53A, wherein the IL-2Rβγc binding compound binds to cyno-IL-2R with an IC50 less than 100 μM as determined using phage ELISA competition assays.

Aspect 55A. A pharmaceutical composition comprising the IL-2Rβγc binding compound of any one of aspects 21A to 54A.

Aspect 56A. The pharmaceutical composition of aspect 55A, further comprising a chemotherapeutic agent, an immunomodulator, a checkpoint inhibitor, a vaccine, or a combination of any of the foregoing.

Aspect 57A. A method of treating a disease in a patient comprising administering to a patient in need of such treatment a therapeutically effective amount of the IL-2Rβγc binding compound of any one of aspects 21A to 54A, or the pharmaceutical composition of any one of aspects 55A to 56A.

Aspect 58A. The method of aspect 57A, wherein the disease is selected from cancer, an autoimmune disease, an inflammatory disease, an infectious disease, and a viral disease.

Aspect 59A. A method of expanding immune cells comprising contacting a population of immune cells ex vivo or in vivo with an effective amount of the IL-2Rβ ligand of any one of aspects 1A to 10A, the IL-2Rγc ligand of any one of aspects 11A to 20A, or the IL-2Rβγc binding compound of any one of aspects 21A to 54A.

Aspect 60A. A method of cell therapy comprising engineering a cell to express the IL-2Rβγc binding compound of any one of aspects 21A to 54A.

Aspect 61A. A method of boosting a vaccine comprising administering to a patient a vaccine and a therapeutically effective amount of the IL-2Rβγc binding compound of any one of aspects 21A to 54A, or the pharmaceutical composition of any one of aspects 55A to 56A.

Aspect 62A. A method of modifying the immune response comprising administering to a patient an effective amount of the IL-2Rβγc binding compound of any one of aspects 21A to 54A, or the pharmaceutical composition of any one of aspects 55A to 56A.

Aspect 63A. A nucleic acid encoding for the IL-2Rβ ligand of any one of aspects 1A to 10A, the IL-2Rγc ligand of any one of aspects 11A to 21A, or the IL-2Rβγc binding compound of any one of aspects 22A to 54A.

EXAMPLES

The following examples describe in detail methods of synthesizing IL-2Rβγc ligands, methods of synthesizing IL-2Rβγc constructs, and methods of determining the activity of IL-2Rβγc ligands and IL-2Rβγc ligand constructs provided by the present disclosure. The following examples also describe in detail methods for determining properties of the IL-2Rβγc ligands and IL-2Rβγc constructs provided by the present disclosure. It will be apparent to those skilled in the art that many modifications, both to materials and methods, may be practiced without departing from the scope of the invention.

In the examples, the IL-2Rβ subunit refers to human IL-2Rβ (CD122 protein, Fc Tag) (27-239), Accession No. NP_000869.1 and was obtained from ACRObiosystems, Inc., product number ILB-H5253.

The IL-2Rγc subunit refers to human IL-2Rγc (CD132 protein, Fc Tag) (23-254), Accession No. AAH14972 and was obtained from ACRObiosystems, Inc., product number ILG-H5256.

The cyano-IL-2Rβ subunit refers to the cynomolgus monkey IL-2Rβ subunit, Accession No. NP_000869.1 and was obtained from Sino Biological Inc., product number 90328-C02H.

In the examples, the IL-2Rγc subunit refers to the cynomolgus monkey Rγc subunit, Accession No. XP_005503949.1

Example 1

Synthesis of IL-2Rβ Ligands, IL-2Rγc Ligands and Peptidyl IL-2Rβγc Ligands

IL-2Rβ ligands, IL-2Rγc ligands, and peptidyl IL-2Rβγc ligands were synthesized by single chain solid phase synthesis.

2-Cholorotrityl resin (1 g, 1.5 mmole/g, from Anaspec) was washed with DMF (2×), and then allowed to stand in 50 mL DMF for 10 min. The swollen resin was treated with an activated solution of Fmoc-glycine prepared from 5 eq. of amino acid and 5 eq. of HATU dissolved at 0.5M in DMF, followed by the addition of 10 eq. of DIEA, and the mixture gently stirred for 30 min at 25° C. The resin was washed (DMF, THF, DCM, and MeOH) and dried to yield the Fmoc-protected resin. Fmoc groups were then removed by gently shaking the resin with 30% piperidine in DMF for 20 min, followed by washing (DMF, THF, DCM, and MeOH), and drying. The resin was then subjected to repeated cycles of Fmoc-amino acid couplings with HATU activation and Fmoc removal with piperidine to build a desired amino acid sequence. Except for the four cysteine residues of the sequence, standard 95% TFA-labile amino acid side-chain protecting groups were used. For the two cysteine residues proximal to the resin, Trt protection was used, and for the two cysteine residues distal to the resin, Acm protection was used. After Fmoc removal from the final amino acid of the dimer sequence, the terminal amine groups were acylated with acetic anhydride (10 eq.) and DIEA (20 eq.) in DMF for 20 min, followed by washing as described above.

The completed peptide was cleaved from the resin by suspension in a solution of TFA (95 vol %), water (2.5 vol %), and triisopropylsilane (2.5 vol %) for 3 h at 25° C. The TFA solution was cooled to 5° C. and poured into Et$_2$O to precipitate the peptide. Filtration and drying under reduced pressure gave the desired peptide. Purification via preparative HPLC with a C18 column afforded the pure peptide with the two C-terminal thiol groups in a reduced state. This peptide was dissolved in 20% DMSO/water (1 mg dry weight peptide/mL) and allowed to stand at 25° C. for 36 h, and then purified by reverse phase HPLC to provide the peptide with the two C-terminal thiols linked by a disulfide bridge. The two N-terminal Acm-protected cysteine residues were then deprotected by dissolving 0.1 mmole of peptide in 25 mL of 50% acetic acid/H$_2$O and 2.5 mL of 1M HCl and adding 5 mL of 0.1M iodine (in glacial acetic acid; 5 eq.) dropwise with stirring under a nitrogen atmosphere. The deprotection/oxidation reaction was allowed to proceed for 2 h at 25° C. with frequent monitoring (analytical HPLC) to ensure complete reaction. The reaction was stopped by addition of ice-cooled diethyl ether (9 volume eq.). The resulting solution was cooled on dry ice (3 min), the ether solution carefully decanted, and the resulting light-yellow solid purified by preparative reverse phase HPLC (95%) to yield the final single-chain peptide dimer.

Example 2

Synthesis of IL-2Rβγc Ligands Using Click Chemistry

The peptide sequences of an IL-2Rβ ligand and an IL-2Rγ ligand were synthesized separately using standard solid phase synthesis conditions and Fmoc-protected amino acids as described in Example 1.

Rink amide-MBHA resin (1 g, 1.5 mmole/g, Anaspec) was washed with DMF (2×), and then allowed to stand in 50 mL DMF for 10 min. Separate portions of the swollen resin were treated with either an activated solution of Fmoc-propargyl glycine (IL-2Rβ ligand) or 2-(Fmoc-NH)-5-azido-pentanoic acid (IL-2Rγc ligand) prepared from 5 eq. of amino acid and 5 eq. of HATU dissolved at 0.5M in DMF, followed by the addition of 10 eq. of DIEA, and the mixture was gently stirred for 30 min at 25° C. The resin was washed (DMF, THF, DCM, and MeOH) and dried to yield the Fmoc-protected resin. Fmoc groups were then removed by gently shaking the resin in 30% piperidine in DMF for 20 min, followed by washing (DMF, THF, DCM, and MeOH), and drying. The resin was then subjected to repeated cycles of Fmoc-amino acid couplings with HATU activation and Fmoc removal with piperidine to provide a desired IL-2Rβ ligand amino acid sequence and a desired IL-2Rβγc ligand amino acid sequence. Standard 95% TFA-labile amino acid sidechain protecting groups were used for all residues. After Fmoc removal from the final amino acid of each ligand sequence, the terminal amine groups were acylated with acetic anhydride (10 eq.) and DIEA (20 eq.) in DMF for 20 min.

Each completed ligand was cleaved from the resin by suspension in a solution of TFA (95%), water (2.5%), and triisopropylsilane (2.5%) for 3 h at 25° C. The TFA solution was cooled to 5° C. and poured into Et$_2$O to precipitate the peptide. Filtration and drying under reduced pressure gave the desired ligands. Purification via preparative HPLC with a C18 column afforded the pure peptides with the two thiol groups in a reduced state. The ligands were separately dissolved in 20% DMSO/water (1 mg dry weight peptide/ mL), allowed to stand at 25° C. for 36 h., and then purified by reverse phase HPLC to provide the IL-2Rβ and IL-2Rγc ligands with the two thiols linked via an intramolecular disulfide bridge.

Two-tenths (0.2) mL of a 2.0 mM solution of purified alkyne-containing IL-2Rβ ligand was prepared by dissolving the ligand in 1:1 H$_2$O/tBuOH. Similarly, 0.2 mL of a 2.4 mM solution of the purified azide-containing ligand was prepared using the same solvent. The two ligand solutions along with 0.1 mL of 100 mM CuSO$_4$ in H$_2$O, 0.1 mL of 250 mM of a Cu(I) chelating agent such as DIEPA, pyridine, or THPTA (tris(3-hydroxypropyltriazolylmethyl)amine), in 3:1 DMSO/tBuOH, 0.1 mL of 0.5 M ascorbic acid in H$_2$O, and 0.3 mL of 3:2 tBuOH/H$_2$O were combined, and the reaction allowed to proceed at 45° C. under anaerobic conditions. Reaction progress was monitored frequently by LC/MS, and additional azide-containing ligand and CuSO$_4$ were added to drive the reaction to completion. After the maximal amount of alkyne was consumed (approx. 3 h), the reaction was quenched by addition of approx. 8 mL of 1:1 H$_2$O/ACN, and the peptide dimer purified (95%) using a preparative-scale C18 HPLC column.

The structure of IL-2Rβ ligands and IL-2Rγc ligands used in the experimental examples is provided in Tables 8 and 9, and in FIGS. 19A-19C.

TABLE 8

IL-2Rβ Ligands.

| | |
|---|---|
| SEQ ID NO: 58 | Y D C R I A Q V G E L C D L |
| SEQ ID NO: 671 | V Q Y K K C W M A Q L G D L C E L D P S |
| SEQ ID NO: 664 | Y P C H M A Q L G E L C D L s W G D I |
| SEQ ID NO: 612 | Y P C W M A Q L G E L C D L |
| SEQ ID NO: 865 | W Y P C W M A Q L G E L C D L D |
| SEQ ID NO: 869 | F Y P C W T A L L G E L C D L E P G P P A M |
| SEQ ID NO: 870 | W G T T W R W Y P C W M A Q L G E L c D L E |
| SEQ ID NO: 864 | D V L G D R W Y P C W I A K L G E L c D L D |
| SEQ ID NO: 874 | W Y P C W I A Q L G E L C D L D |
| SEQ ID NO: 875 | W Y P C W L A K L G E L C D L D |
| SEQ ID NO: 901 | W Y P C W M A Q L G D L C D L E K P V T E R |
| SEQ ID NO: 856 | W R R W Y P C W V A Q V G E L C D L E I E A |
| SEQ ID NO: 858 | R Q R W Y P C W M A R L G E L C D L D E P T |

TABLE 9

IL-2Rγc Ligands.

| | |
|---|---|
| SEQ ID NO: 222 | V M C E R W Q G V E L C W L |
| SEQ ID NO: 224 | D C S M W E G V E L C W |
| SEQ ID NO: 965 | V V C Q D W E G V E L C W Q |
| SEQ ID NO: 985 | W S K K A E V V C E E W G G V E F C W I |
| SEQ ID NO: 1024 | R T G V E C Q D W H G V E L C W P V W E |
| SEQ ID NO: 1028 | V G I E C E E W A G V E L C W L |
| SEQ ID NO: 981 | T W N M S E L E C Q D W N G V E I C W H |
| SEQ ID NO: 1026 | R T E V E C E D W E G V E L C W L |

Example 3

STAT5 Phosphorylation in TF-1P Cells with IL-2Rβγc Ligands Having Different Ligands/Orientations/Linkers IL-2Rβγc ligands were evaluated for induction of STAT5 phosphorylation in TF-1β cells. TF-1β cells were derived from the growth factor-dependent human erythroleukemia cell line TF-1 (ATCC #CRL-2003), which naturally expresses IL-2Rγc but not IL-2Rβ. The cells were engineered to be IL-2 responsive by transfection with human full-length IL-2Rβ. A cell line expressing higher levels of IL-2Rβ was selected by growth in IL-2, and both IL-2Rβ and IL-2Rγc subunit expression levels were verified by qPCR and FACS analysis.

To test compounds for induction of STAT5 phosphorylation TF-1β cells were starved overnight at $5 \times 10^5$ cells/mL in starvation medium (RPMI 1640+2.5 g/L glucose+5% FBS+2 mM L-glutamine+1 mM NaPyr+10 mM HEPES with no GM-CSF or rhIL-2 supplement) in T75 flasks. The following day, cells were plated in 96-well V-bottom plates at $2 \times 10^5$ cells/well. Three-fold serial dilutions of IL-2Rβγc ligands or IL-2 in starvation media were added to the cells and incubated for 30 min at 37° C. Cell extracts were prepared by adding a mixture of 10× Cell Lysis Buffer (Cell Signaling Technology #9803) and 1×HALT Phosphatase and Protease Inhibitor Cocktail (Thermo Fisher #78442) directly to the wells. The plates were agitated at 25° C. for 5 min to prepare cell extracts for immediate use or stored at −80° C. Detection of pSTAT5 was performed using a PathScan® Phospho-Stat5 (Tyr694) Sandwich ELISA Kit (Cell Signaling Technology #7113). Cell extracts were added to microwells that were pre-coated with a mouse anti-phospho-STAT5 antibody and incubated overnight at 4° C. Wells were then washed with PBS and bound phospho-STAT5 (Tyr694) was detected by adding a rabbit anti-STAT5 detection antibody and incubating for 1 h at 37° C. Wells were washed with PBS and an anti-rabbit IgG HRP-linked antibody was added to each well. After a final wash TMB substrate solution was added to measure the amount of HRP in each well. Absorbance at 450 nm was read in a microplate reader. The signal that was produced is proportional to the quantity of phosphorylated STAT5 in each cell extract.

Figure 2:
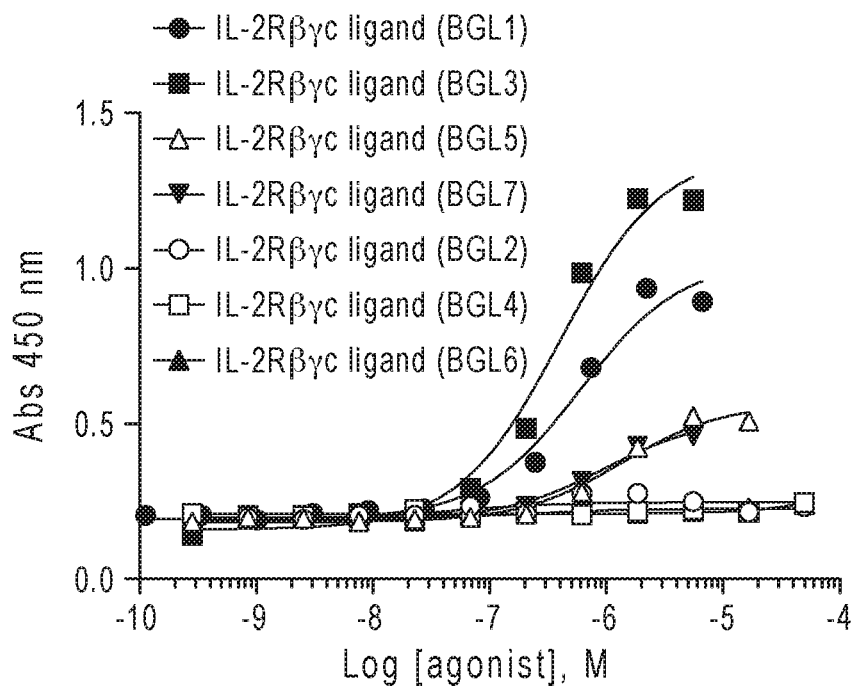
FIG. 2 shows STAT5 phosphorylation in TF-1β cells exposed to various IL-2Rβγc ligands having different IL-2Rβ and IL-2Rγc ligands with different C/N orientations and different ligand linker lengths.

The results are presented in FIG. 2.

The structures of the IL-2Rβγc ligands evaluated in FIG. 2 are provided in FIGS. 19A-19C.

Example 4

STAT5 Phosphorylation in NK-92 Cells with IL-2Rβγc Ligands Having Different IL-2Rβ and IL-2Rγc Ligands with a C/C Orientation and with the Same Ligand Linker IL-2Rβγc ligands were evaluated for induction of STAT5 phosphorylation in NK-92 cells, a human cell line that expresses all three IL-2 receptor subunits, and which is responsive to IL-2Rβγc-biased variants as well as wild type IL-2. To test compounds for induction of STAT5 phosphorylation, NK-92 cells were starved overnight in starvation medium (RPMI 1640+20% FBS+2 mM L-glutamine+1 mM NaPyr+10 mM HEPES+0.1 mM BME with no rhIL-2 supplement) at 37° C. in T75 flasks. The following day, the NK-92 cells were plated in 96-well V-bottom plates at $2\times10^5$ cells/well. Three-fold serial dilutions of test compounds or IL-2 in starvation media were added to the cells and incubated for 30 min at 37° C.

Cell extracts were prepared and the amount of phosphorylated STAT5 was measured using the PathScan® Phospho-Stat5 (Tyr694) Sandwich ELISA Kit as described in Example 3.

Figure 3:
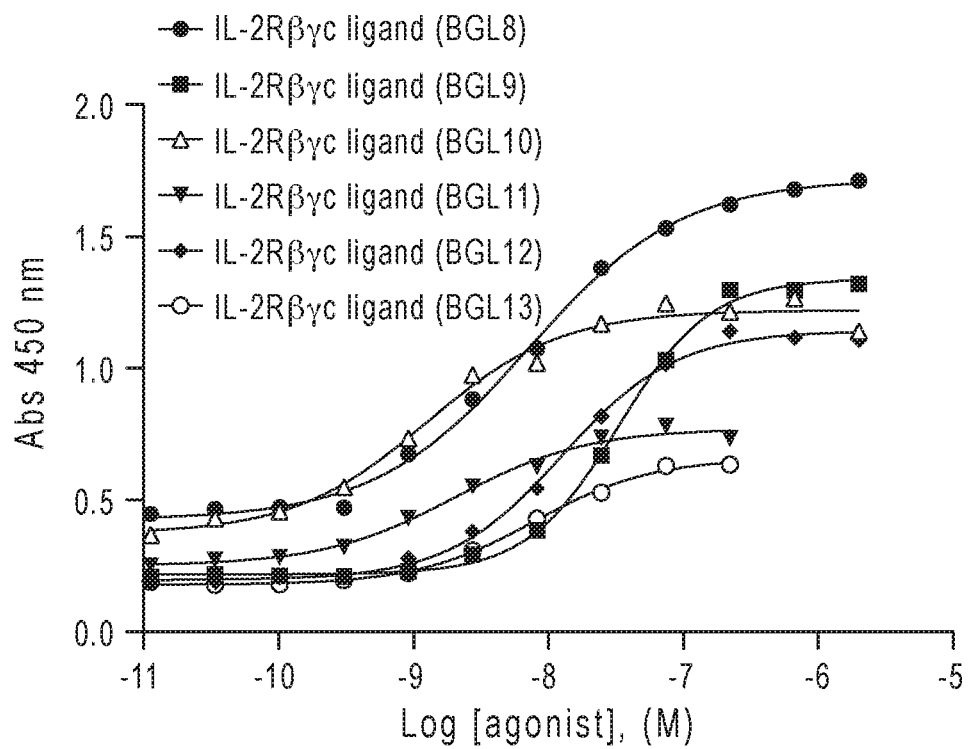
FIG. 3 shows STAT5 phosphorylation in NK-92 cells exposed to various IL-2Rβγc ligands having different IL-2Rβ and IL-2Rγc ligands with a C/C orientation and with the same IL-2Rβγc ligand linker.

The results are presented in FIG. 3.

The structures of the IL-2Rβγc ligands evaluated in FIG. 3 are provided in FIGS. 19A-19C.

Example 5

STAT5 Phosphorylation in NK-92 Cells with IL-2Rβγc Ligands Having Different Orientations The agonist activity of IL-2Rβγc ligands comprising the same IL-2Rβ and IL-2Rγc ligands bound to the same ligand linker but with different N/C orientations was evaluated using a STAT5 phosphorylation assay in NK-92 cells.

IL-2Rβγc ligands were incubated with NK-92 cells and STAT5 phosphorylation measured as a function of concentration using the methods described in Example 4.

Figure 4:
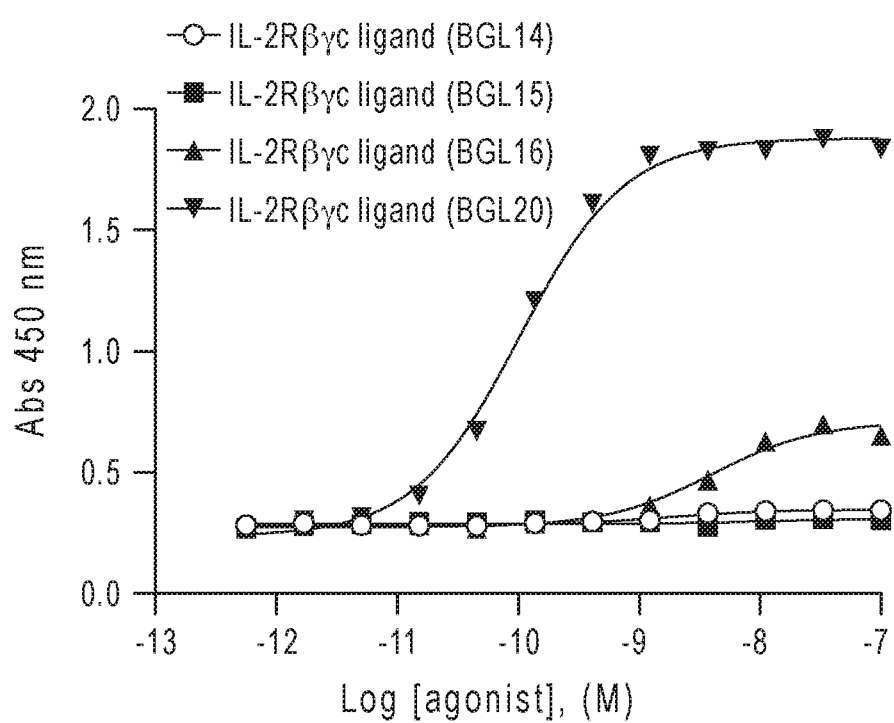
FIG. 4 shows STAT5 phosphorylation in NK-92 cells exposed to IL-2Rβγc ligands having an IL-2Rβ ligand having SEQ ID NO: 865 (BL4) and an IL-2Rγc ligand of SEQ ID NO: 965 (GL2), with different C/N orientations.

The results are presented in FIG. 4.

The structures of the IL-2Rβγc ligands evaluated in FIG. 4 are provided in FIGS. 19A-19C.

Example 6

STAT5 Phosphorylation in TF-1β Cells with IL-2Rβγc Ligands with Different Ligands The agonist activity of IL-2Rβγc ligands comprising different IL-2Rβ and IL-2Rγc ligands bound to the same synthetic ligand linker and with the same N/C orientation was evaluated using a STAT5 phosphorylation assay in TF-1β cells.

Compounds were incubated with TF-1 cells and STAT5 phosphorylation was measured as a function of concentration using the methods described in Example 3.

Figure 5A:
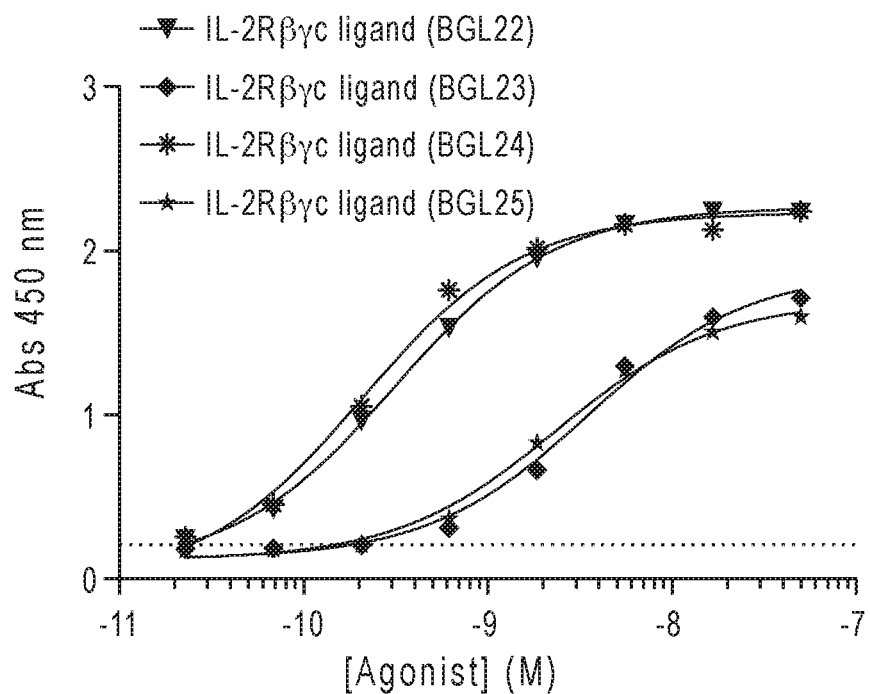
FIGS. 5A and 5B show STAT5 phosphorylation in TF-1β cells exposed to IL-2Rβγc ligands having different IL-2Rβ and IL-2Rγc ligands with a C/N orientation and with the same IL-2Rβγc ligand linker.
Figure 5B:
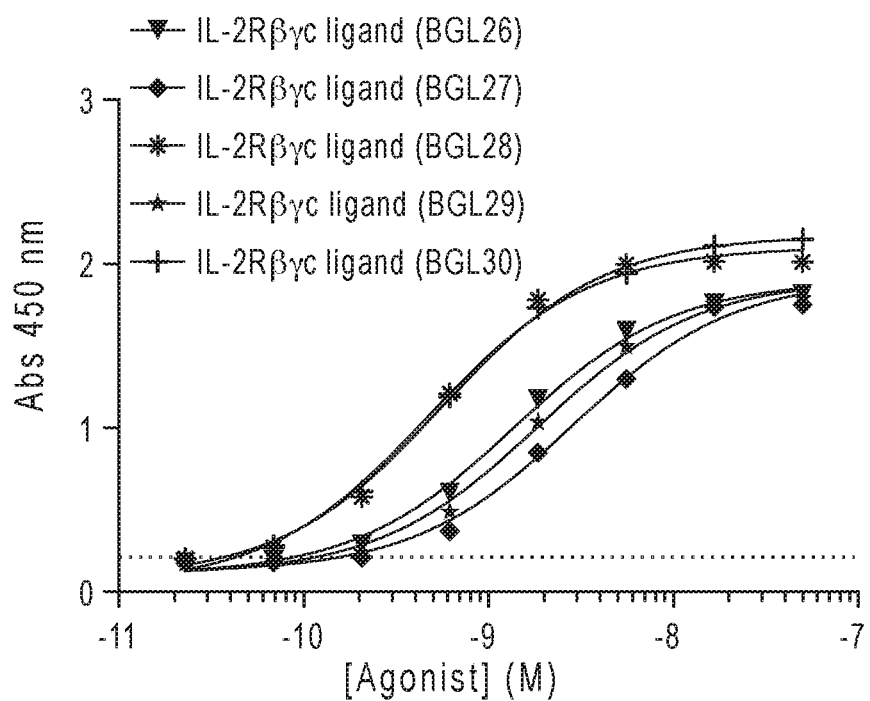

The results are presented in FIGS. 5A and 5B.

The structures of the IL-2Rβγc ligands evaluated in FIGS. 5A and 5B are provided in FIGS. 19A-19C.

Example 7

STAT5 Phosphorylation in NK-92 Cells with IL-2Rβγc Ligands with Different Linkers The agonist activity of IL-2Rβγc ligands comprising the same IL-2Rβ and IL-2Rγc ligands bound to a synthetic IL-2Rβγc ligand linker (IL-2Rβγc ligand (BGL20)) or to a peptidyl IL-2Rβγc ligand linker (IL-2Rβγc ligand (BGL21)) and with the same N/C orientation was evaluated using a STAT5 phosphorylation assay in NK-92 cells.

IL-2Rβγc ligands were incubated with NK-92 cells and STAT5 phosphorylation was measured as a function of concentration using the methods described in Example 4.

Figure 6:
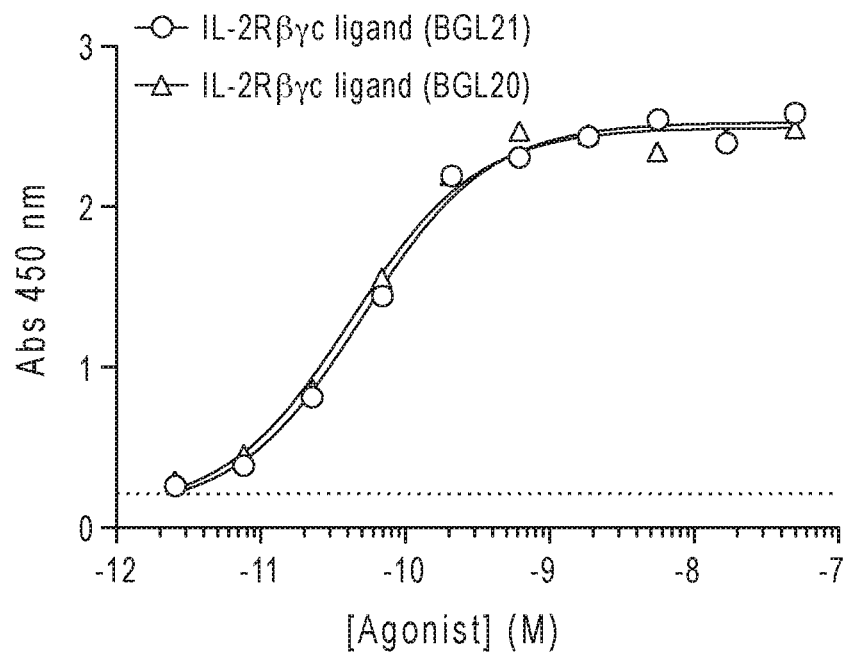
FIG. 6 shows STAT5 phosphorylation in NK-92 cells exposed to IL-2Rβγc ligands having an IL-2Rβ ligand having SEQ ID NO: 865 (BL4) and an IL-2Rγc ligand of SEQ ID NO: 965 (GL2), having either a -GGGGS- (G4S) (SEQ ID NO: 9395) amino acid linker (IL-2Rβγc ligand (BGL21)) or a click chemistry-derived triazole-containing linker (IL-2Rβγc ligand (BGL20)).

The results are presented in FIG. 6.

The structures of the IL-2Rβγc ligands evaluated in FIG. 6 are provided in FIGS. 19A-19C.

Example 8

STAT5, AKT and ERK1/2 Phosphorylation in NK-92 Cells with IL-2 and an IL-2Rβγc Ligand The agonist activity of IL-2 and an IL-2Rβγc ligand (BGL21) was evaluated using STAT5 phosphorylation, AKT phosphorylation, and ERK1/2 phosphorylation assays in NK-92 cells.

Compounds were incubated with NK-92 cells and STAT5 phosphorylation was measured as a function of concentration using the methods described in Example 4. Detection of phosphorylated AKT was performed using the PathScan® Phospho-AKT (Thr308) Sandwich ELISA Kit (Cell Signaling Technology #7252). Detection of phosphorylated ERK1/2 was performed using PathScan® Phospho-p44/42 MAPK (Thr202/Tyr204) Sandwich ELISA Kit (Cell Signaling Technology #7177).

Figure 7A:
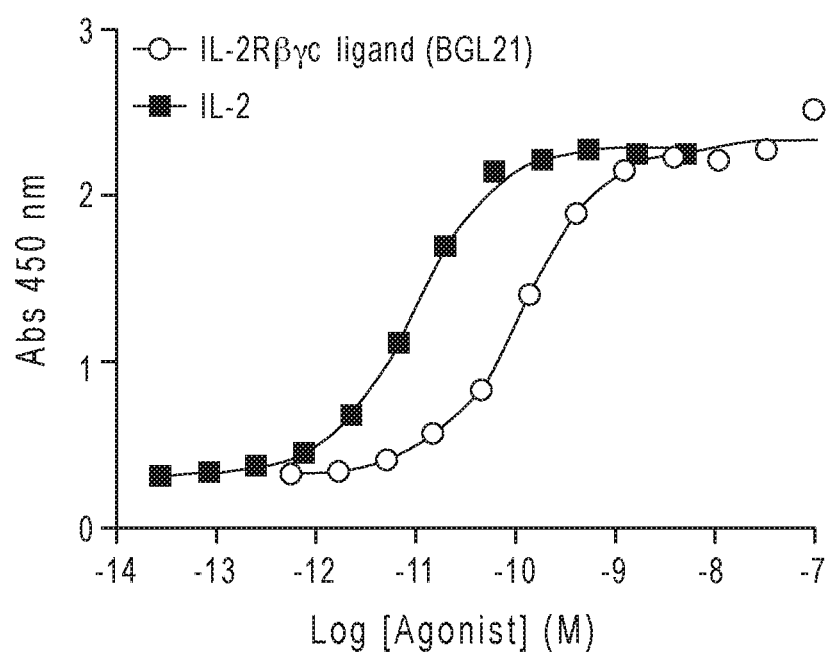
FIGS. 7A-7C show STAT5 phosphorylation in NK-92 cells, AKT phosphorylation in NK-92 cells, and ERK1/2 phosphorylation in NK-92 cells, respectively, following exposure to either IL-2Rβγc ligand (BGL21) or to IL-2.
Figure 7B:
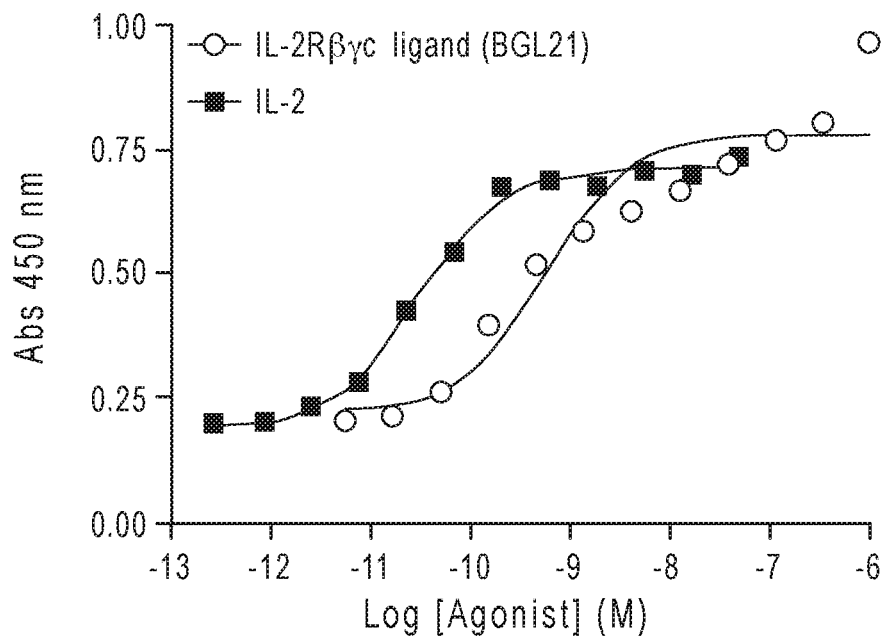
Figure 7C:
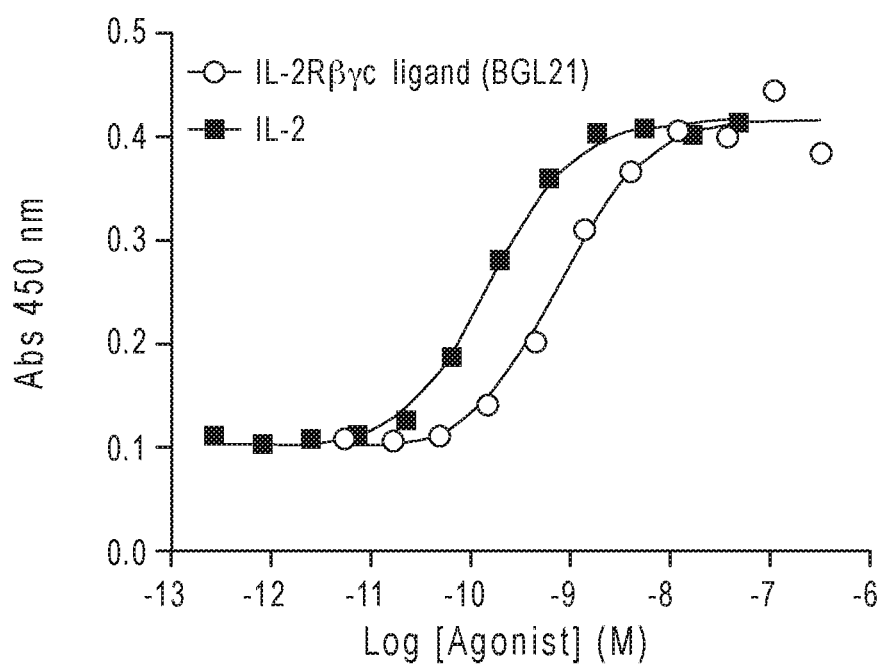

The results are presented in FIG. 7A for STAT5 phosphorylation, in FIG. 7B for AKT phosphorylation, and in FIG. 7C for ERK1/2 phosphorylation.

The structures of the IL-2Rβγc ligands evaluated in FIGS. 7A-7C are provided in FIGS. 19A-19C.

Example 9

Proliferation of NK-92 with IL-2 and an IL-2R 7c Ligand

NK-92 cells were plated in starvation media (minus growth factors) and incubated with serial dilutions of IL-2Rβγc ligand (BGL21) or IL-2 at 37° C. for 48 h. The number of viable cells present in each well was quantified by measuring ATP levels, which is an indicator of metabolically active cells, using a CellTiter-Glo® Assay Kit (Promega #G7571). An equal volume of CellTiter-Glo® reagent was added to each well and incubated at 25° C. for 10 min. Luminescence signals were measured using a Wallac Victor 1420 plate reader. Values (in relative light units (RLU)) were plotted as a function of the concentration of the test compounds.

Figure 8A:
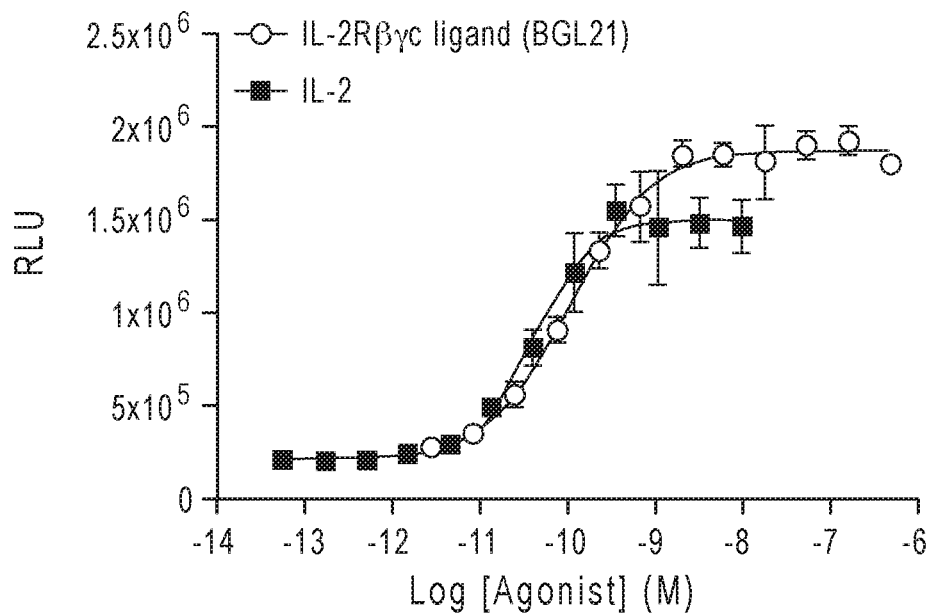
FIGS. 8A and 8B show NK-92 cell proliferation following exposure to either IL-2 or to IL-2Rβγc ligand (BGL21) in terms of viable cell number or % Ki-67+ cells, respectively.

The results are provided in FIG. 8A.

NK-92 cell proliferation in response to IL-2Rβγc ligand (BGL21) or IL-2 was also measured using Ki67 staining. The nuclear protein Ki67 is present during all active phases of the cell cycle but is absent in resting cells. NK-92 cells were resuspended in starvation medium and plated at $2\times10^5$ cells/well in a 96-well plate. Three-fold serial dilution of the test compound was then added to the cells for 48 h. Following the incubation period, cells were treated with Live/Dead® Fixable Aqua Dye (ThermoFisher #L34966) for 30 min to stain for viable cells. The cells were then washed with PBS and then fixed and permeabilized for 1 h at 25° C. with Foxp3 Transcription Factor Fix/Perm® buffer (eBioscience #00-5523). Cells were washed and then stained with anti-Ki67 PE antibody. After a final wash the cells were analyzed by flow cytometry on an LSR II instrument (Becton Dickinson). Data analysis was performed using FlowJo software. The median fluorescence intensity of Ki67+ cells is plotted as a function of test compound concentration.

Figure 8B:
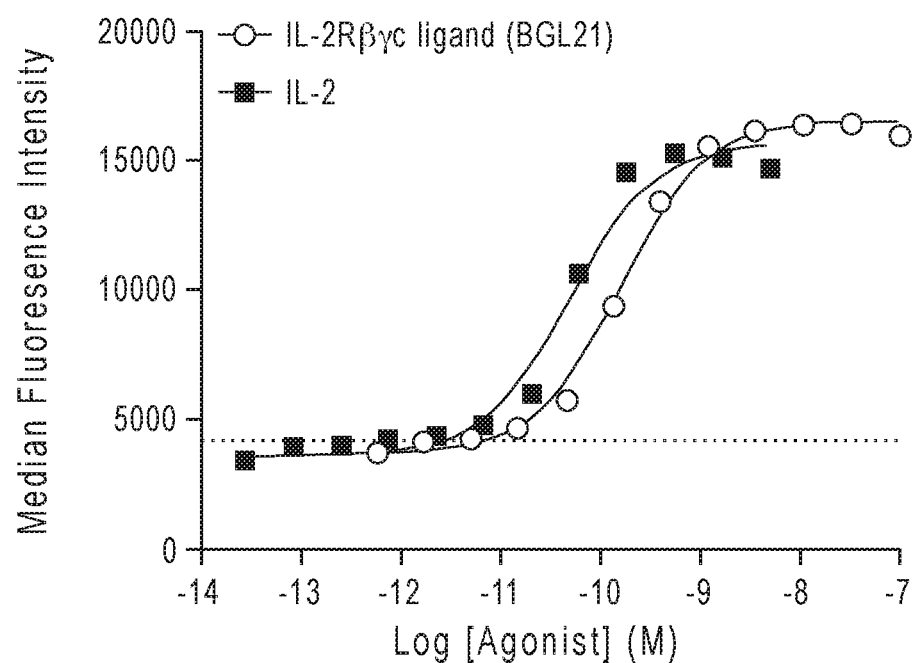

The results are provided in FIG. 8B.

The structure of IL-2Rβγc ligand (BGL21) is provided in FIGS. 19A-19C.

Example 10

STAT-5 Phosphorylation in Resting CD8+ T-cells, CD4+ T-cells and Treg Cells

The agonist activity of IL-2 and an IL-2Rβγc ligand (IL-2Rβγc ligand (BGL21)), in resting CD8+ T-cells, CD4+ T-cells, and Treg cells was evaluated using a STAT5 phosphorylation assay.

Human peripheral blood mononuclear cells (PBMC) were isolated from buffy coats using Lymphoprep® (Stemcell Technologies #07811) density gradient centrifugation. The recovered PBMCs were resuspended in T-cell medium (CTS OpTmizer® medium+2 mM L-glutamine+Pen/Strep with no serum or IL-2) at $2\times10^6$ cells/mL and incubated for 3 h at 37° C. PBMCs were then added to a 96-well deep well plate at $10^6$ cells/well. Three-fold serial dilutions of IL-2Rβγc ligand (BGL21) or IL-2 were added to the cells and incubated for 30 min at 37° C. The cells were then fixed in Fix/Perm® buffer (Transcription Factor Phospho Buffer Set, BD Biosciences #563239) for 50 min on ice, followed by permeabilization in Perm Buffer III for 20 min on ice. Cells were washed several times using Perm/Wash® buffer. Antibody conjugates used for cell surface and intracellular staining are shown in Table 10.

TABLE 10

Antibody conjugates used for cell surface and intracellular staining.

| Marker | Clone | Channel | Supplier | Cat. No. |
|---|---|---|---|---|
| CD127 | eBioRDR5 | FITC | Invitrogen | 11-1278-42 |
| pSTAT5 | 47 | PE | BD[1] | 612567 |
| CD25 | M-A251 | PE-CF594 | BD | 562403 |
| CD56 | CMSSB | PerCP-eFl710 | Invitrogen | 46-0567-42 |
| CD16 | eBioCB16 | | Invitrogen | 46-0168-42 |
| Foxp3 | 236A/E7 | AF647 | BD | 561184 |
| CD3 | UCHT1 | BV421 | BD | 562426 |
| CD8 | SK1 | BV510 | BD | 563919 |

[1]BD Biosciences.

Antibody mixtures were added to the cells and incubated for 30 min on ice and protected from light. Cells were washed with Perm/Wash® buffer and resuspended in PBS+ 2% FBS. Each test sample was analyzed by flow cytometry on an LSR II instrument (Becton Dickinson). Data analysis was performed using FlowJo software. The percent of pSTAT5+ cells in each blood cell population was plotted as a function of the concentration of test compound.

Figure 9A:
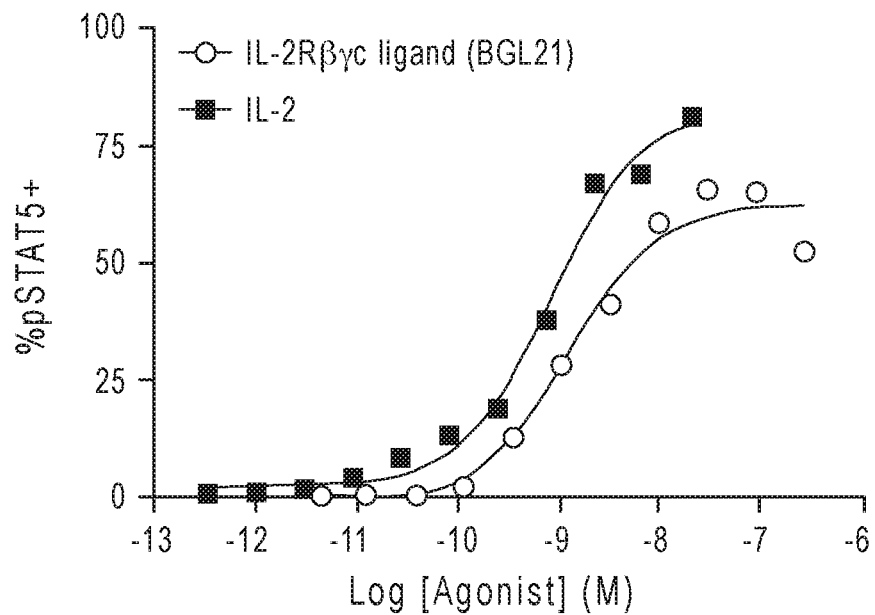
FIGS. 9A-9C show STAT5 phosphorylation in resting CD8+ T-cells, Treg cells, or CD4+ T-cells, respectively, following exposure to either IL-2 or to IL-2Rβγc ligand (BGL21).
Figure 9B:
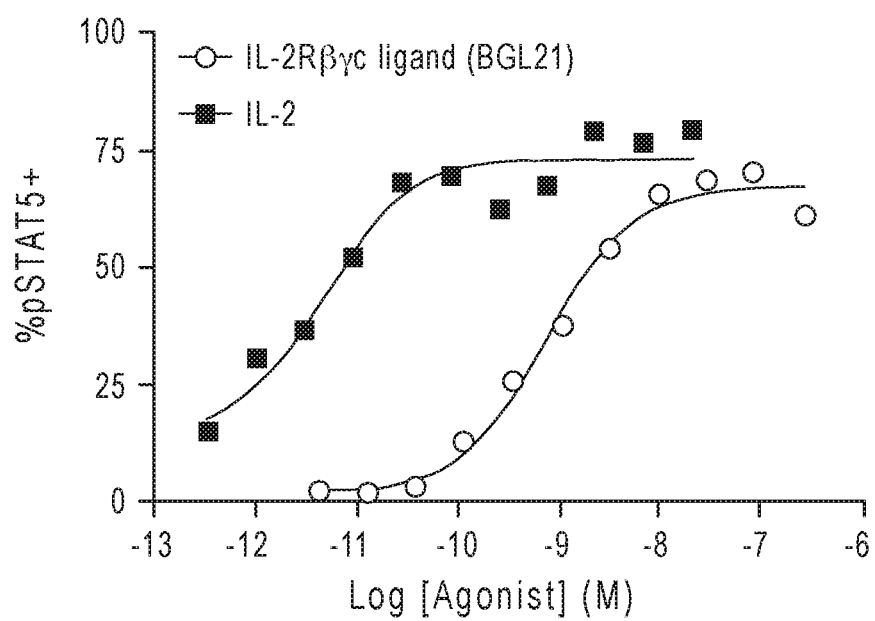
Figure 9C:
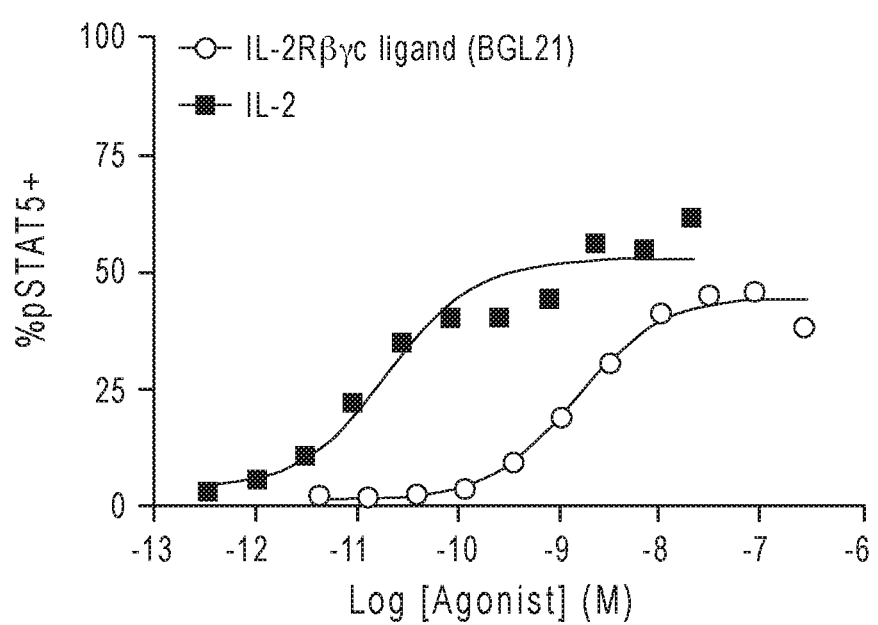

The results are presented in FIGS. 9A-9C.

Example 11

Proliferation in NK Cells from Human PBMCs

Human PBMCs were isolated from a buffy coat by density gradient centrifugation (Lymphoprep®, Stemcell Technologies #07811) and cultured overnight in T-cell medium (CTS OpTmizer®, ThermoFisher #A1048501) at $3\times10^6$ cells/mL in a T75 flask. The following day, cells were resuspended in fresh medium and plated at $5\times10^5$ cells/well in a 96-well cell culture plate. Three-fold serial dilutions of either IL-2 or an IL-2Rβγc ligand (BGL21) were added to the cells and incubated for 3 days at 37° C. After the treatment, cells were incubated in viability dye (Live/Dead® Fixable Aqua Cell Stain Kit, ThermoFisher #L34965) for 30 min at 37° C., after which surface antibody staining was then performed in PBS+2% FBS for 30 min on ice. Cells were fixed and permeabilized with Fixation/Permeabilization Buffer (eBioscience Foxp3/Transcription Staining Buffer Set, ThermoFisher #00-5523-00) for 30 min on ice. Intracellular (Ki-67) staining was performed in Permeabilization Buffer for 30 min on ice and the treated cells resuspended in PBS+2% FBS prior to FACS analysis. NK cells were identified as CD56+ and/or CD159a+ cells from CD3− and CD20− (non-T, non-B cell) populations. Antibody conjugates used for cell surface and intracellular staining are shown in Table 11.

TABLE 11

Antibody conjugates used for cell surface and intracellular staining.

| Marker | CD3 | Ki-67 | CD56 | CD20 | CD45RA | CD8 | CD159a | Live/Dead |
|---|---|---|---|---|---|---|---|---|
| Fluor | FITC | PE | PerCP-eFluor710 | PE-Cy7 | APC | BV421 | BV650 | Aqua |
| Clone | UCHT1 | SolA15 | CMSSB | 2H7 | HI100 | SKI | 131411 | — |
| Vendor | Invitrogen | Invitrogen | Invitrogen | BioLegend | BD | BioLegend | BD | Invitrogen |
| Cat. no. | CD0301 | 12-2698-82 | 46-0567-42 | 302312 | 550855 | 344748 | 747920 | L349650 |

Figure 10A:
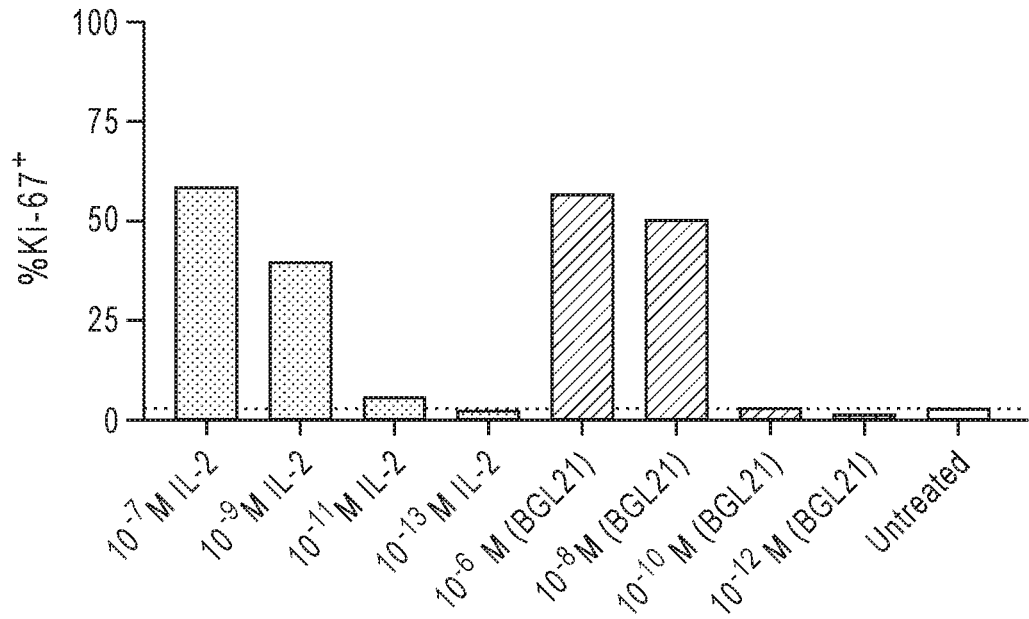
FIGS. 10A and 10B show proliferation of NK-92 cells following exposure to either IL-2 or to IL-2Rβγc ligand (BGL21) in terms of % Ki-67+ cells and median fluorescence intensity, respectively.
Figure 10B:
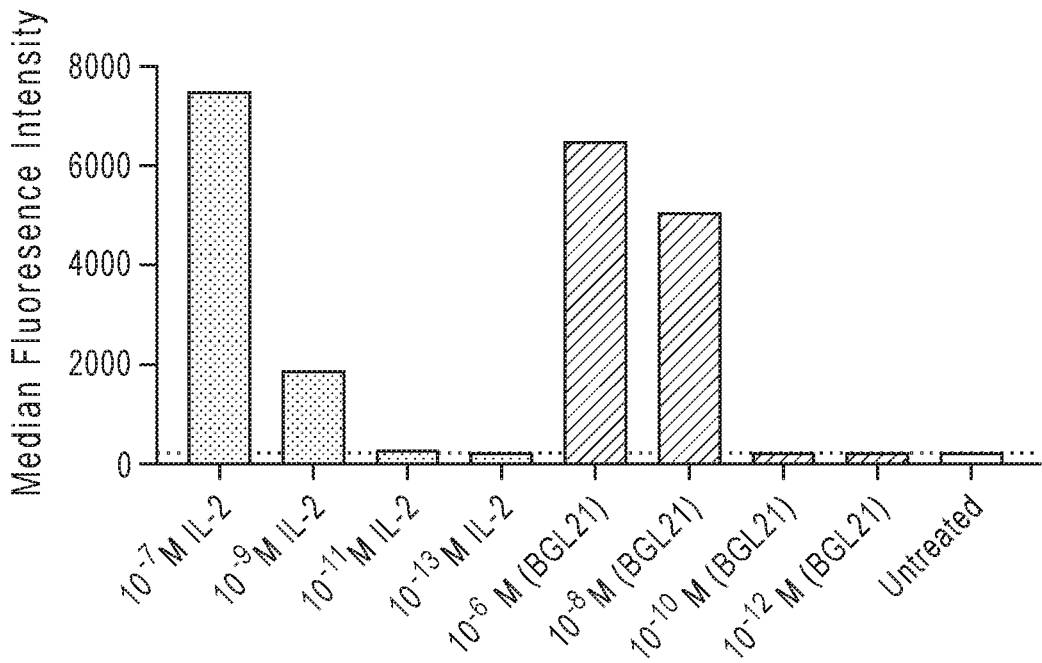

The results are presented in FIGS. 10A and 10B.

Example 12

Upregulation of PD-L1 in A549 Tumor Cells and Tumor Cell Lysis PD-L1 Upregulation Human peripheral blood mononuclear cells (PBMC) were isolated from buffy coats by density gradient centrifugation. Human lung carcinoma A549 cells (ATCC CCL-185) were seeded overnight in 6-well plates at $10^6$ cells/well. The next day, freshly isolated PBMCs were added to the A549 cells at $10^7$ cells/well for a final effector-to-target ratio (E:T) of 10:1. Serial dilutions of IL-2Rβγc ligand (BGL21) or IL-2 were added to the wells and cells were incubated at 37° C. for 48 h. PBMCs were then aspirated from the wells and the adherent A549 cells were collected using 0.25% (w/v) Trypsin-0.53 mM EDTA solution. Cells were washed with PBS and stained with the antibody mixture shown in Table 12 to quantify the levels of PD-L1 expression on A549 cells and to exclude PBMCs from the analysis.

TABLE 12

Cell-staining antibody mixture.

| Marker | CD14 | PD-L1 | CD56 | CD20 | CD3 |
|---|---|---|---|---|---|
| Channel | FITC | PE | PerCP-eFl710 | PE-Cy7 | BV421 |

Samples were analyzed by flow cytometry on an LSR II instrument (Becton Dickinson). The percent of A549 cells staining positive for PD-L1 was plotted as a function of the concentration of the test compound.

Figure 11A:
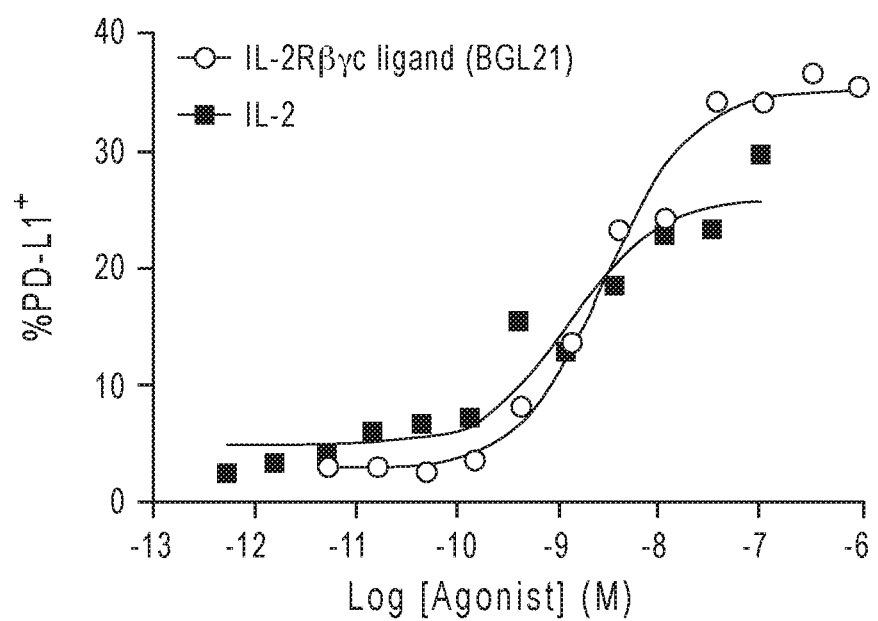
FIG. 11A shows the upregulation of PD-L1 expression in A549 tumor cells following co-culture with PBMCs and either IL-2 or IL-2Rβγc ligand (BGL21).

The results are presented in FIG. 11A.

Example 13

PBMC Tumor Cell Lysis

Freshly isolated PBMCs (effector cells) were resuspended in T-cell medium (CTS OpTmizer medium+2 mM L-glutamine+Pen/Strep with no serum or hIL-2) and plated at $6\times10^5$ cells/well in a 96-well cell culture plate. Human colon carcinoma cell lines LS180 (ATCC CL-187) and COLO 205 (ATCC CCL-222) (target cells) were added to the PBMCs at $3\times10^4$ cells/well for a final E:T ratio of 20:1. Dilutions of an IL-2Rβγc ligand (BGL21) or IL-2 were then added to the wells and cells were incubated at 37° C. for 48 hours. Cell supernatants were collected by centrifugation and 50 μL from each well was transferred to a 96-well plate. Tumor cell lysis was quantified by measuring LDH release with the Promega CytoTox 96® Non-Radioactive Cytotoxicity Assay Kit (#G1780). An equal volume of CytoTox 96® reagent was added to each well and incubated at 25° C. for 30 min. Stop solution (50 μL) was then added to each well to terminate the reaction and the absorbance signal was measured at 490 nm in a Wallac Victor 1420 plate reader. The percent cytotoxicity was calculated by dividing the value obtained for each sample by the maximum value obtained from supernatants obtained from wells treated with lysis buffer.

Figure 11B:
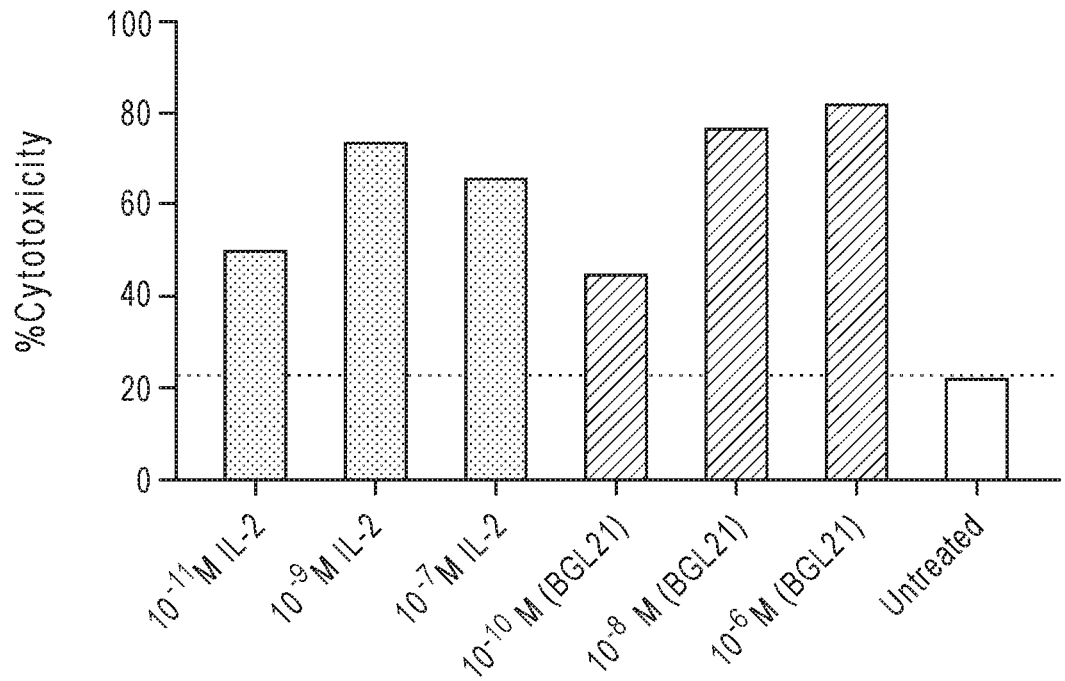
FIGS. 11B and 11C show the % cytotoxicity in LS180 cells and the % cytotoxicity in COLO205 cells, respectively, following co-culture with PBMCs and either IL-2 or IL-2Rβγc ligand (BGL21).
Figure 11C:
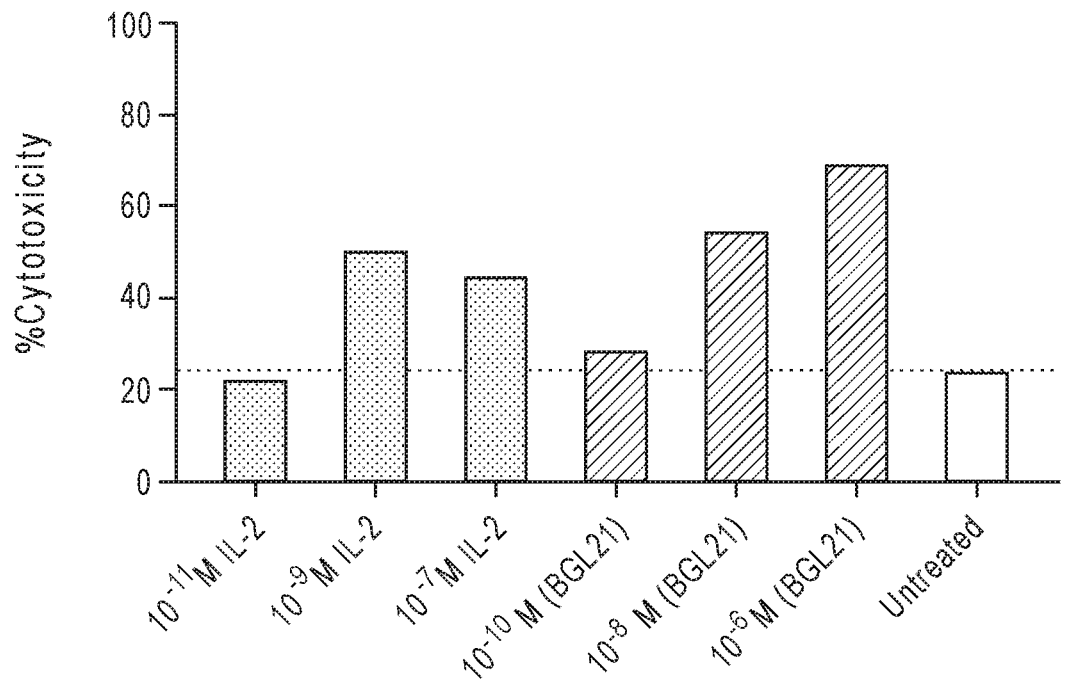

The results are presented in FIGS. 11B and 11C.

Example 14

Recombinant Fusion Proteins Incorporating an IL-2Rβγc Ligand

Immunoglobulin Fusions: Multiple mammalian expression vectors were constructed to express IL-2Rβγc ligands linked to full-length human IgG, or to Fc-fragments consisting of the CH2 and CH3 domains of the heavy chain and hinge regions of human IgG1, IgG2, or IgG4. Each vector contained a strong constitutive promoter (CMV or hEFI-HTLV) and an IL-2 signal peptide sequence for secretion of the fusion protein into the culture media. Vectors were designed to enable peptide ligands to be fused to either the N- or C-terminus of the immunoglobulin proteins and to incorporate construct linkers of varying lengths between the IL-2Rβγc ligands and IgG.

Fusion proteins were transiently expressed in 293 human embryonic kidney cells (FreeStyle® 293-F) by transfecting plasmid DNA into the cells using polyethyleneimine reagent PEI MAX (Polysciences, Inc.). Transfected cells were grown in FreeStyle® 293 Expression Medium (Thermo Fisher) in shaker flasks in a 37° C. humidified $CO_2$ incubator on an orbital shaker rotating at 125 rpm. Cultures were harvested 96 h post-transfection by centrifugation and the secreted fusion proteins were purified from the supernatants using protein A affinity chromatography.

Protein A agarose resin was mixed with culture supernatant and incubated at room temperature for several hours. The resin was then washed three times with PBS and bound IgG IL-2Rβγc ligand fusion was eluted with 0.1 M glycine buffer (pH 2.8). Eluates were neutralized with 1M Tris buffer and quantified by measuring absorbance at 280 nm using a NanoDrop® spectrophotometer. Protein concentrations were determined using calculated extinction coefficients derived from the primary sequence of the protein. Size exclusion chromatography was used to remove high molecular weight impurities prior to measuring the activities of the fusion proteins in bioassays.

Human Serum Albumin Fusion: A mammalian expression vector was constructed to express IL-2Rβγc ligands linked to the C-terminus of human serum albumin (HSA). A 6×-His tag (SEQ ID NO: 9431) was linked to the N-terminus of HSA for purification purposes. The vector contains a strong constitutive promoter (hEFI-HTLV) and an IL-2 signal peptide sequence for secretion of the fusion protein into the culture media.

HSA-IL-2Rβγc ligand fusion protein was transiently expressed in 293 human embryonic kidney cells (Free-Style® 293-F) by first transfecting plasmid DNA into the cells using polyethyleneimine reagent PEI MAX (Polysciences, Inc.). Transfected cells were grown in FreeStyle® 293 Expression Medium (Thermo Fisher) in shaker flasks in a 37° C. humidified $CO_2$ incubator on an orbital shaker rotating at 125 rpm. Cultures were harvested 96 h post-transfection by centrifugation and the secreted HSA-IL-2Rβγc ligand fusion protein was purified from the supernatant by Ni-NTA affinity chromatography.

Ni-NTA agarose resin was added to the culture supernatant and incubated at room temperature for several hours. The resin was then washed three times with TBS wash buffer (25 mM Tris pH 8.0, 150 mM NaCl, 20 mM imidazole). Bound HSA-IL-2Rβγc ligand fusion protein was eluted from the resin with elution buffer (25 mM Tris pH 8.0, 150 mM NaCl, 250 mM imidazole) followed by buffer exchange to remove imidazole using Zeba® spin columns (Thermo Fisher). Protein was quantified by measuring absorbance at 280 nm using a NanoDrop® spectrophotometer and concentration was determined using calculated extinction coefficients derived from the primary sequence of the protein.

The amino acid sequences of the IL-2Rβγc ligand fusion proteins used in the experimental examples is provided in FIGS. 20A-20J and 21A-21C.

The hIgG2 Fc-fragment refers to the Fc region consisting of the CH2 and CH3 domains of the IgG2 heavy chain and the hinge region. The first and second cysteines of the hinge region were replaced with serine to prevent detrimental disulfide bridges. The last amino acid (lysine) of the Fc region was replaced with an alanine for fusion stability. The N-terminus of IgG2 Fc constructs starts with Ala-Pro-Leu (derived from InvivoGen vector).

The hIgG1v Fc-fragment refers to the Fc region consisting of the CH2 and CH3 domains of the IgG1 heavy chain and the hinge region. The first cysteine of the hinge region was replaced with a serine to prevent detrimental disulfide bridges. The last amino acid (lysine) of the Fc region was replaced with an alanine for fusion stability. Effector silencing mutations P329G, L234A/L235A (LALA) were included in the IgG1v Fc-(BGL21) construct (FP2) (SEQ ID NO: 1213). The N-terminus of the IgG1v Fc construct starts with Ala (derived from InvivoGen vector).

The hIgG4 Fc-fragment refers to the Fc region consisting of the CH2 and CH3 domains of the IgG4 heavy chain and the hinge region. Effector silencing mutations P329G, S228P/L235E (SPLE) were included in the hIgG4 Fc variant (FP3) (SEQ ID NO: 1214).

Fc-Knob refers to the Human Hinge Knob Fc IgG1 LALA-dK (decreased effector function and low C-terminal heterogeneity) (L252A, L253A, T384W).

Fc-Hole refers to the Human Hinge Hole Fc IgG1 LALA-dK (decreased effector function and low C-terminal heterogeneity) (L252A, L253A, T384W, L386A, Y425V).

The hIgG1 Fc-fragment refers to the Fc region consisting of the CH2 and CH3 domains of the IgG1 heavy chain and the hinge region. The last amino acid (lysine) of the Fc region was replaced with alanine for fusion stability. The construct includes effector silencing mutation N297A.

The hIgG2 Fc-fragment refers to the Fc region consisting of the CH2 and CH3 domains of the IgG2 heavy chain and the hinge region. The first and second cysteines of the hinge were replaced with serines to prevent detrimental disulfide bridges. The last amino acid (lysine) of the Fc region was replaced with alanine for fusion stability.

Amino acid sequences of IL-2Rβγc ligand fusion proteins used in the experimental examples are provided in FIGS. 20A-20J.

Example 15

STAT5 Phosphorylation in TF-1P Cells with IL-2Rβγc Ligand Fusion Proteins

IL-2Rβγc ligand (BGL21) was fused to an IgG Fc-fragment consisting of the CH2 and CH3 domains of the heavy chain and hinge regions of human IgG2 (C-terminal fusion SEQ ID NO: 1212; N-terminal fusion SEQ ID NO: 1215) as described in Example 14. IL-2Rβγc ligand (BGL21) was also fused to a heterodimeric Fc-fragment (Knob-into-holes) variant consisting of the CH2 and CH3 domains of the heavy chain and hinge regions of human IgG1. IL-2Rβγc ligand (BGL21) was fused to the C-terminus of the knob-Fc-fragment (SEQ ID NO: 1216) which contains a "knob" mutation (T366W) and effector silencing mutations (L234A/L235A). The construct was co-expressed with a hole-Fc-fragment (SEQ ID NO: 1217), which contains "hole" mutations (T366S, L368A, Y407V) and effector silencing mutations (L234A/L235A), to produce a heterodimeric Fc-fragment with a single copy of IL-2Rβγc ligand (BGL21) at the C-terminus of the fusion protein. In addition to fusions to Fc-fragments, IL-2Rβγc ligand (BGL21) was also fused to the C-terminus of human serum albumin (SEQ ID NO: 1252) as described in Example 14.

Fusion proteins were incubated with TF-1β cells and STAT5 phosphorylation was measured as a function of concentration using the methods described in Example 3.

The structure of the IL-2Rβγc ligand fusion proteins is provided in FIGS. 20A-20J and 21A-21C.

Figure 12:
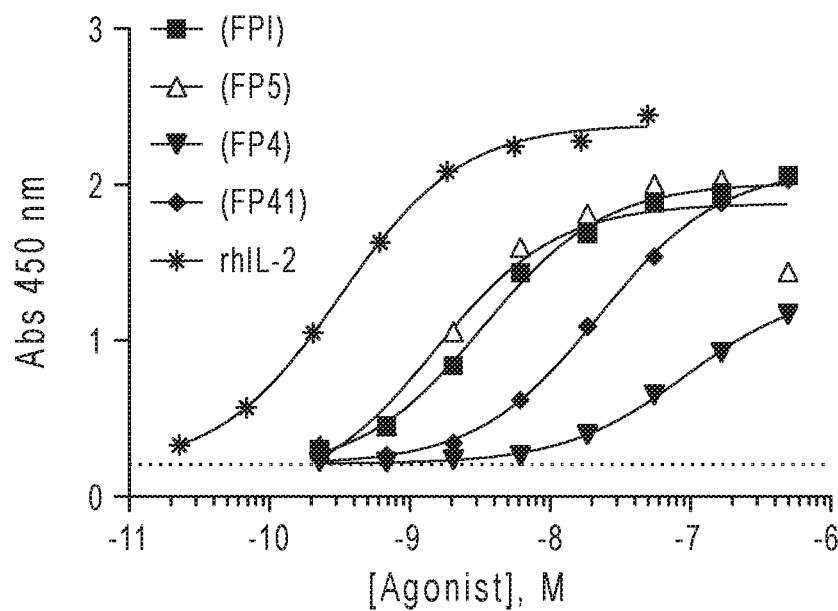
FIG. 12 shows the STAT5 phosphorylation in TF-1β cells following exposure to IL-2 or to various IL-2Rβγc ligand (BGL21)-fusion proteins.

The results are presented in FIG. 12.

Example 16

STAT5 Phosphorylation in TF-1P Cells with Different IL-2Rβγc Ligand IgG2 Fc-Fragment Fusion Proteins A series of IL-2Rβγc ligands were fused to the C-terminus of an IgG2 Fc-fragment consisting of the CH2 and CH3 domains of the heavy chain and hinge regions of human IgG2 as described in Example 14. The IL-2Rβγc ligands included IL-2R and IL-2Rγc ligands exhibiting various binding affinities to IL-2R that were linked together with a flexible linker $(GGGGS)_2$ (SEQ ID NO: 9396) between the two peptide sequences.

Fusion proteins were incubated with TF-1β cells and STAT5 phosphorylation was measured as a function of concentration using the methods described in Example 3.

The structures of the Fc-IL-2Rβγc ligand fusion proteins evaluated is provided in FIGS. 20 and 23 as SEQ ID NOS: 1212, 1239, 1243, 1244, 1250, and 1251.

Figure 13:
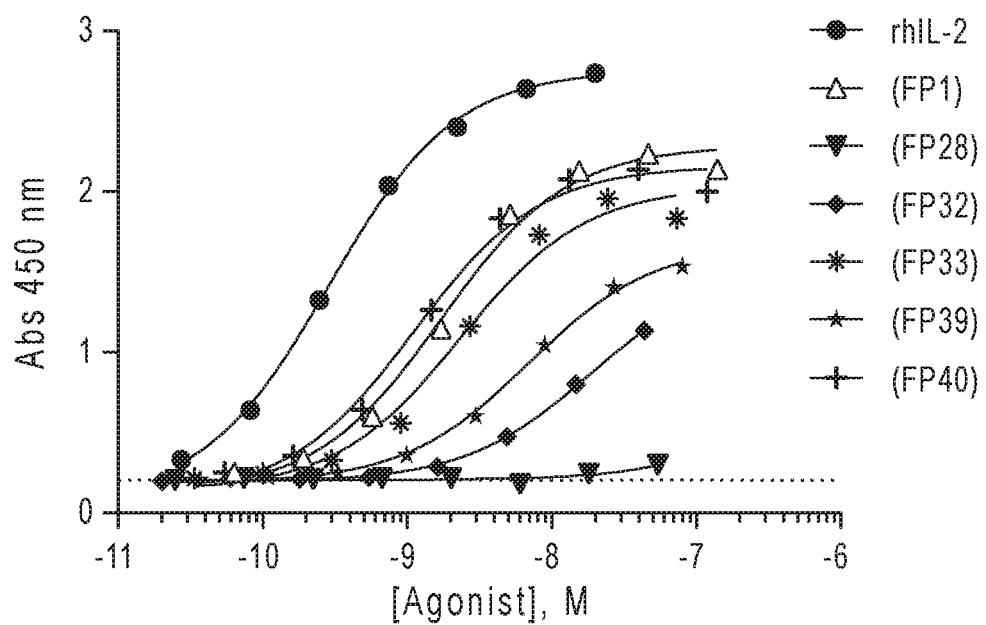
FIG. 13 shows the STAT5 phosphorylation in TF-1β cells following exposure to IL-2 or to various IL-2Rβγc ligand-Fc fusion proteins having different IL-2Rβγc ligands.

The results are presented in FIG. 13.

Example 17

STAT5 Phosphorylation in NK-92 Cells with Fusion Proteins Including an IL-2Rβγc Ligand Bound to the Fc-Fragment of Different IgG Isotypes IL-2Rβγc ligand (BGL21) was fused to Fc-fragments consisting of the CH2 and CH3 domains of the heavy chain and hinge regions of three different isotypes of human IgG. In the first construct (FP2; SEQ ID NO: 1213) IL-2Rβγc ligand (BGL21) was fused to the C-terminus of a human IgG1 Fc-fragment variant in which the first cysteine in the hinge region was replaced by a serine to prevent detrimental disulfide bridges and the last amino acid (lysine) was replaced by alanine for fusion stability. Effector silencing mutations were also included in this variant (P329G, L234A/L235A). The second construct (FP1; SEQ ID NO: 1212) IL-2Rβγc ligand (BGL21) was fused to the C-terminus of a human IgG2 Fc-fragment variant in which the first and second cysteines in the hinge region were replaced by serine to prevent detrimental disulfide bridges and the last amino acid (lysine) was replaced by alanine for fusion stability. In a third construct (FP3; SEQ ID NO: 1214) IL-2Rβγc ligand (BGL21) was fused to the C-terminus of a human IgG4 Fc-fragment variant that contained effector silencing mutations (P329G, S228P/L235). Each fusion protein was expressed and purified as described in Example 14.

Fusion proteins were incubated with TF-1 cells and STAT5 phosphorylation was measured as a function of concentration using the methods described in Example 3.

The structure of the IgG Fc-IL-2Rβγc ligand fusion proteins (FP1)-(FP3) is provided in FIGS. 20A and 21A-21C and corresponds to SEQ ID NOS: 1212, 1213, and 1214.

Figure 14:
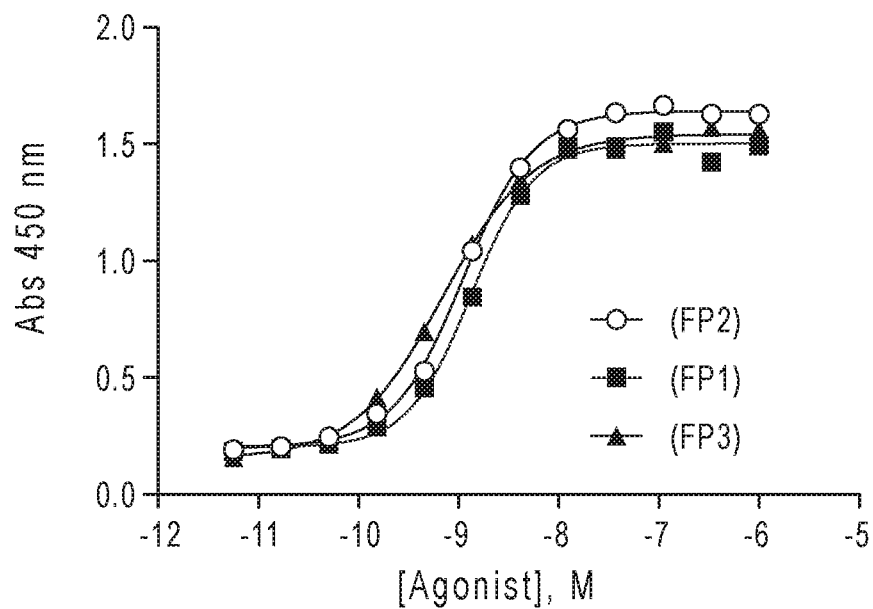
FIG. 14 shows the STAT5 phosphorylation in TF-1β cells following exposure to various IL-2Rβγc ligand (BGL21)-Fc fusion proteins derived from different IgG isotypes.

The results are presented in FIG. 14.

Example 18

STAT5 Phosphorylation in TF-1P Cells with IL-2Rβγc Ligand IgG2 Fc-Fragment Fusion Proteins Having Different Fc Linkers IL-2Rβγc ligand (BGL21) IgG2 Fc-fragment variants containing a series of flexible construct linkers with glycine or glycine/serine repeats, or rigid construct linkers with proline/alanine repeats between the Fc-fragment and the C-terminal IL-2Rβγc ligand (BGL21) were prepared as described in Example 14.

Fusion proteins were incubated with TF-1 cells and STAT5 phosphorylation was measured as a function of concentration using the methods described in Example 3.

The structure of the Fc-IL-2Rβγc ligand fusion proteins is provided in FIGS. 20A-20J and 21A-21C and correspond to IL-2Rβγc ligand fusion proteins (FP16)-(FP24) corresponding to SEQ ID NOS: 1227-1235.

Figure 15:
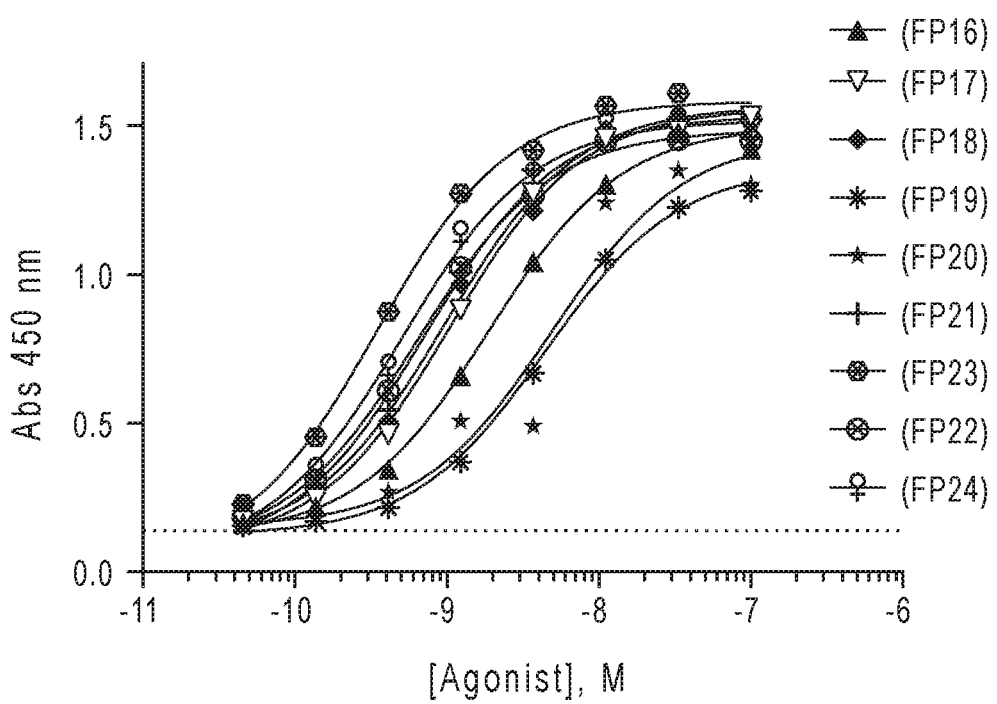
FIG. 15 shows the STAT5 phosphorylation in TF-1β cells following exposure to IL-2Rβγc ligand (BGL21)-Fc fusion proteins having different Fc linkers.

The results are presented in FIG. 15.

Example 19

STAT5 Phosphorylation in TF-1P Cells and NK-92 with IL-2Rβγc Ligand IgG2 Fc-Fragment Fusion Proteins Having Different Fc Linkers IL-2Rβγc ligand (BGL21) IgG2 Fc-fragment variants that contained a flexible linker consisting of a $(GS)_{10}$ (SEQ ID NO: 9407) (see FP14; SEQ ID NO: 1225) flexible linker or a rigid linker consisting of $(PA)_{10}$ (SEQ ID NO: 9428) (see FP15; SEQ ID NO: 1226) between the IgG2 Fc-fragment and the C-terminus of IL-2Rβγc ligand (BGL21) were prepared as described in Example 14.

The fusion proteins were incubated with TF-1D cells and STAT5 phosphorylation was measured as a function of concentration using the methods described in Example 3. Each fusion protein was also tested in a NK-92 cell proliferation assay using Ki67 staining to quantify cells that proliferated in response to the compounds as described in Example 9.

The structures of the Fc-IL-2Rβγc ligand fusion proteins are provided in FIGS. 20A-20J and 21A-21C. In FIGS. 21A-21C the amino acid sequence of the parent IL-2Rβ ligand and parent IL-2Rγc ligand are referenced. Each of the IL-2Rβ ligands and each of the IL-2Rγc ligands used in the Fc-IL-2Rγc fusion proteins includes two flanking glycines on each of the N-terminus and the C-terminus of the parent ligand. For example, IL-2Rβγc ligand fusion protein (FP1) having SEQ ID NO: 1212, includes IL-2Rβ ligand having SEQ ID NO: 914, which corresponds to parent IL-2Rβ ligand having SEQ ID NO: 865 (BL4) with glycines on each of the N-terminus and C-terminus, bound to IL-2Rγc ligand having SEQ ID NO: 1052, which corresponds to parent IL-2Rγc ligand having SEQ ID NO: 965 (GL2) with two glycines on each of the N-terminus and C-terminus.

Figure 16A:
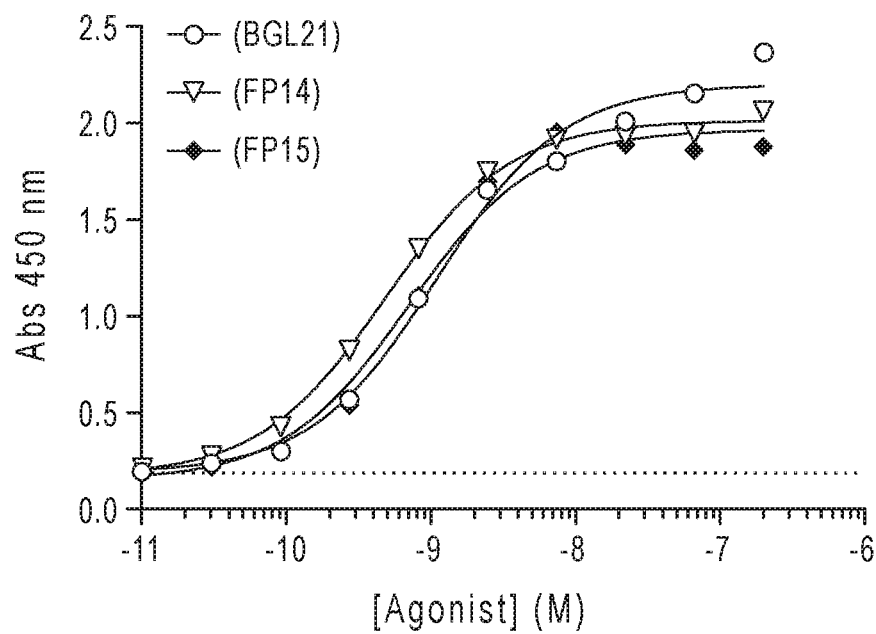
FIGS. 16A and 16B show the STAT5 phosphorylation in TF-1β cells (FIG. 16A) or % Ki-67 activity (FIG. 16B) in NK-92 cells following exposure to IL-2Rβγc ligand (BGL21) or to IL-2Rβγc ligand (BGL21)-Fc fusion proteins having different Fc linkers.
Figure 16B:
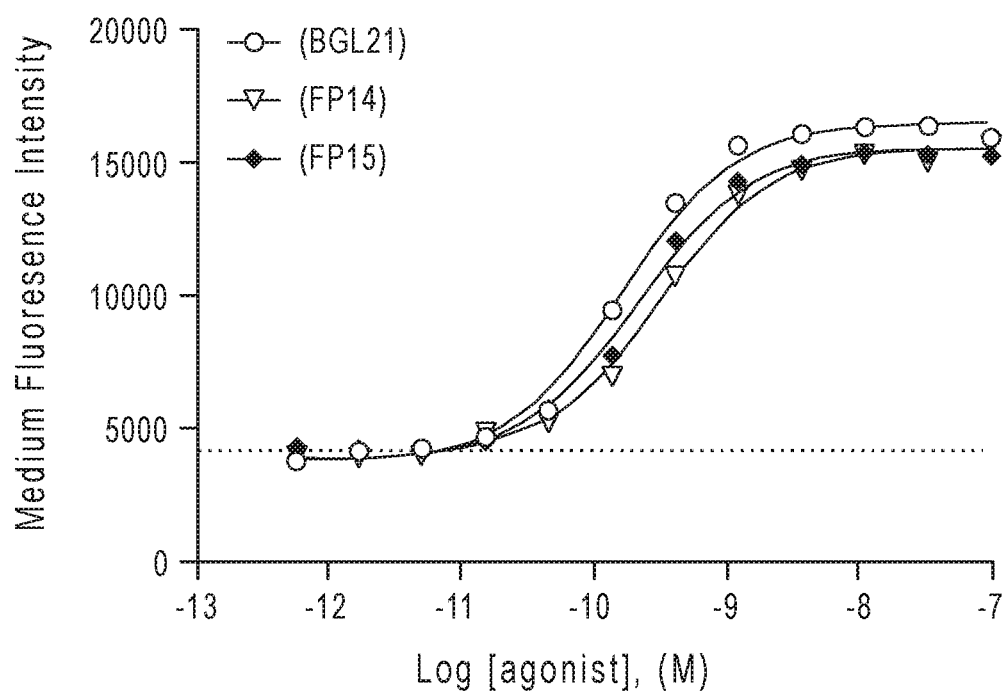

The results are presented in FIGS. 16A and 16B.

Example 20

PD-1 Binding and IL-2 Agonist Activity of Anti-PD-1 Antibody-IL-2Rβγc Ligand (BGL21) Fusion Proteins IL-2Rβγc ligand (BGL21) was fused to the C-terminus of the heavy chains of two therapeutic checkpoint inhibitor antibodies that target PD-1 (Pembrolizumab (FP8) (SEQ ID NO: 1219; Cemiplimab (FP10) (SEQ ID NO: 1221) as described for heterodimeric peptide fusions to IgG Fc-fragments in Example 14. The constructs were transiently co-expressed with their corresponding light chain constructs (Pembrolizumab (FP7; SEQ ID NO: 1218); Cemiplimab (FP9; SEQ ID NO: 1220) in HEK-293F cells to produce full IgG IL-2Rβγc ligand (BGL21) fusions.

Figure 17A:
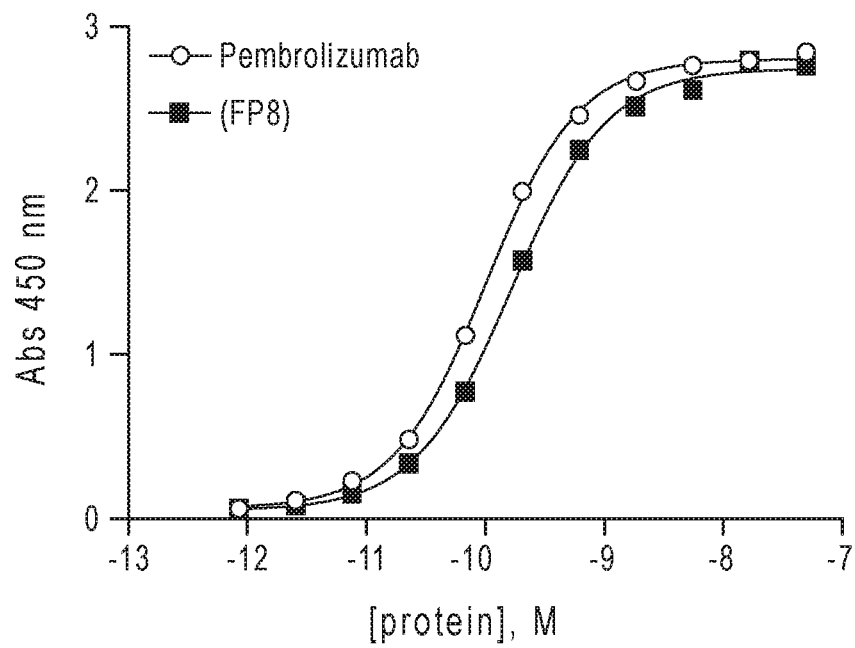
FIGS. 17A-17D show PD-1 binding affinity (FIGS. 17A and 17C) and IL-2R agonist activity as determined by STAT5 phosphorylation (FIGS. 17B and 17D) in TF-1β cells following exposure to an anti-PD-1 antibody (pembrolizumab or cemiplimab), to an IL-2Rβγc ligand (BGL21)-Fc fusion protein (FP1) (SEQ ID NO: 1212), or to an IL-2Rβγc ligand (BGL21)-anti-PD-1 antibody (FP8) (SEQ ID NO: 1219) and (FP10) (SEQ ID NO: 1221).
Figure 17B:
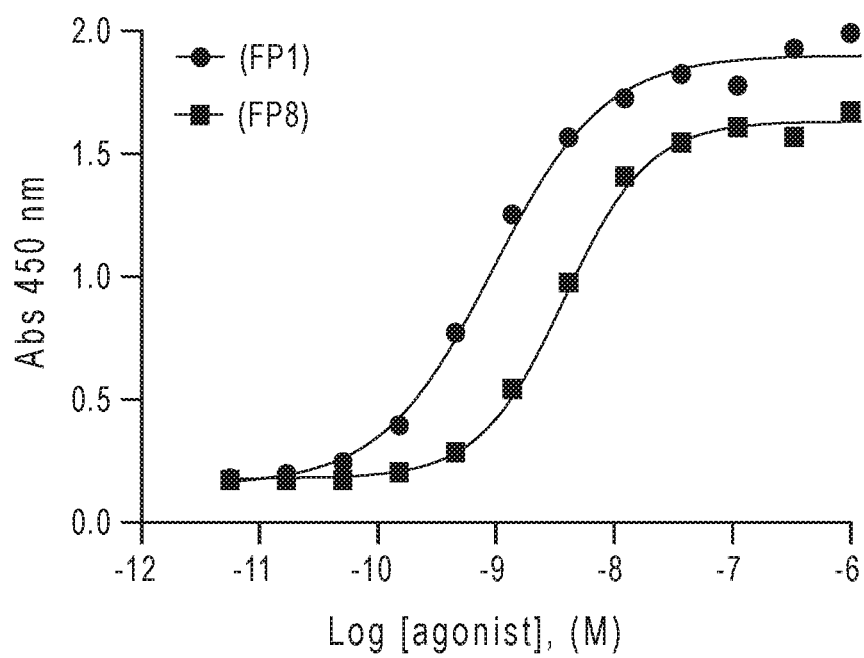
Figure 17C:
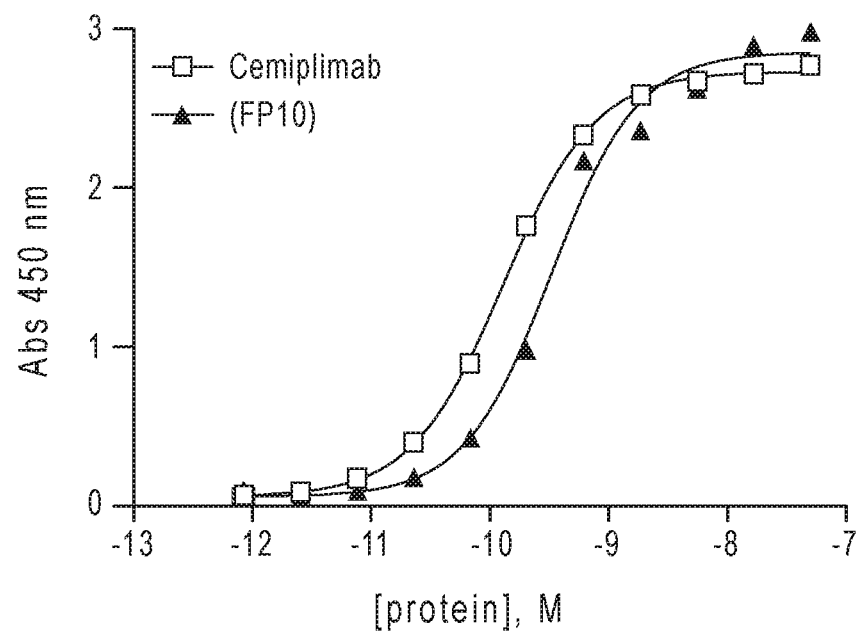

Purified proteins were evaluated for binding to PD-1 target protein by ELISA. Recombinant human PD-1 his tagged protein (R&D Systems 8986-PD-100) was dissolved in PBS at 1 µg/mL and directly immobilized in microtiter wells by absorption followed by blocking with PBS/1% BSA. Serial dilutions of Pembrolizumab and Cemiplimab antibodies or the corresponding IL-2Rβγc ligand (BGL21) fusion proteins were added to the wells and incubated for 1 h at 4° C. Wells were then washed with PBS and an anti-human IgG HRP-linked antibody was added to each well and incubated for 1 hour at 4° C. After a final wash TMB substrate solution was added to measure the amount of HRP in each well. Absorbance at 450 nm was read in a microplate reader. The signal that is produced is proportional to the quantity of antibody bound to PD-1 in each well. The result of the binding to PD-1 is shown in FIGS. 17A and 17C.

Figure 17D:
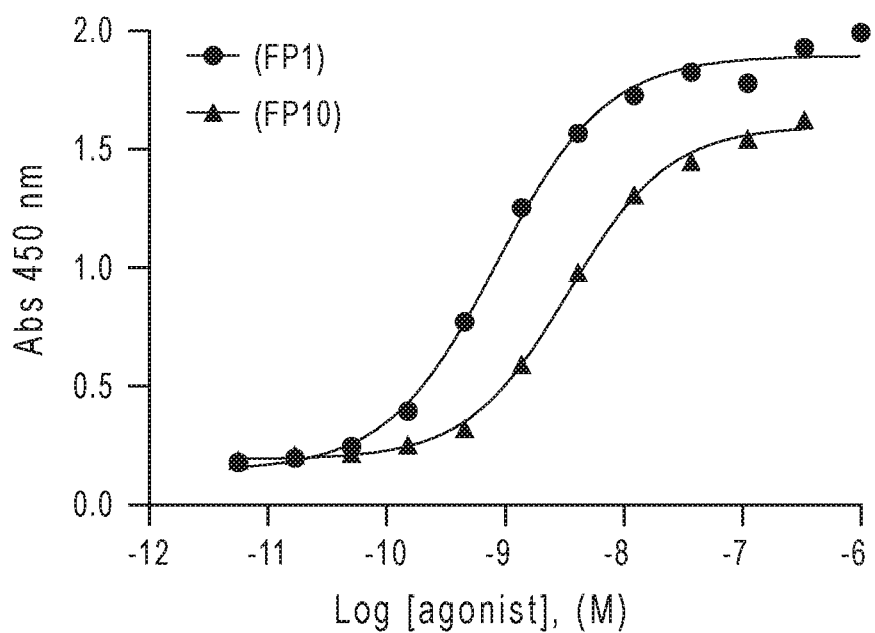

Pembrolizumab and Cemiplimab IL-2Rβγc ligand (BGL21) fusion proteins were incubated with TF-1β cells and STAT5 phosphorylation was measured as a function of concentration using the methods described in Example 3. The results of the STAT5 phosphorylation assay are shown in in FIGS. 17B and 17D, respectively.

The structure of the Fc-IL-2Rβγc ligand fusion proteins is provided in FIGS. 20A-20J and 21A-21C.

Example 21

Synthesis of PEGylated IL-2Rβγc Ligand (BGL21) Construct

An analog of IL-2Rβγc ligand (BGL21) was prepared as described in Example 1 except instead of acetylating the N-terminal primary amine with acetic anhydride, Fmoc-$PEG_{10}$-$CH_2CH_2$—$CO_2H$ (Anaspec, Hayward, Calif.) was added to the N-terminus using a final HATU-mediated coupling step, and the Fmoc-protecting group was removed as described previously. Cleavage from the resin and disulfide formation were performed as described in Example 1 to provide the oxidized peptide with a free N-terminal primary amine. The IL-2Rβγc ligand (BGL21) (1.5 molar equivalents) was mixed with the NHS-ester of a 40 kD branched PEG reagent (1.0 molar equivalent) (NOF Corp., Tokyo, Japan) in dry DMF. After gentle stirring for 15 min at 25° C., DIEA (10 molar equivalents) was added, and the reaction allowed to proceed to completion (approx. 4 h; analysis by analytical C18 reverse phase HPLC). The final product (PEG-8) was purified by C18 reverse phase HPLC, and the structure of the PEGylated peptide was confirmed by MALDI ToF (time of flight) mass spectrometry and reverse phase HPLC.

Example 22

Agonist Activity of PEG-IL-2Rβγc Ligand

The PEG-IL-2Rβγc ligand construct synthesized in Example 21 (PEG-8) was incubated with NK-92 cells and STAT5 phosphorylation was measured as a function of concentration using the methods described in Examples 3 and 4.

Figure 18:
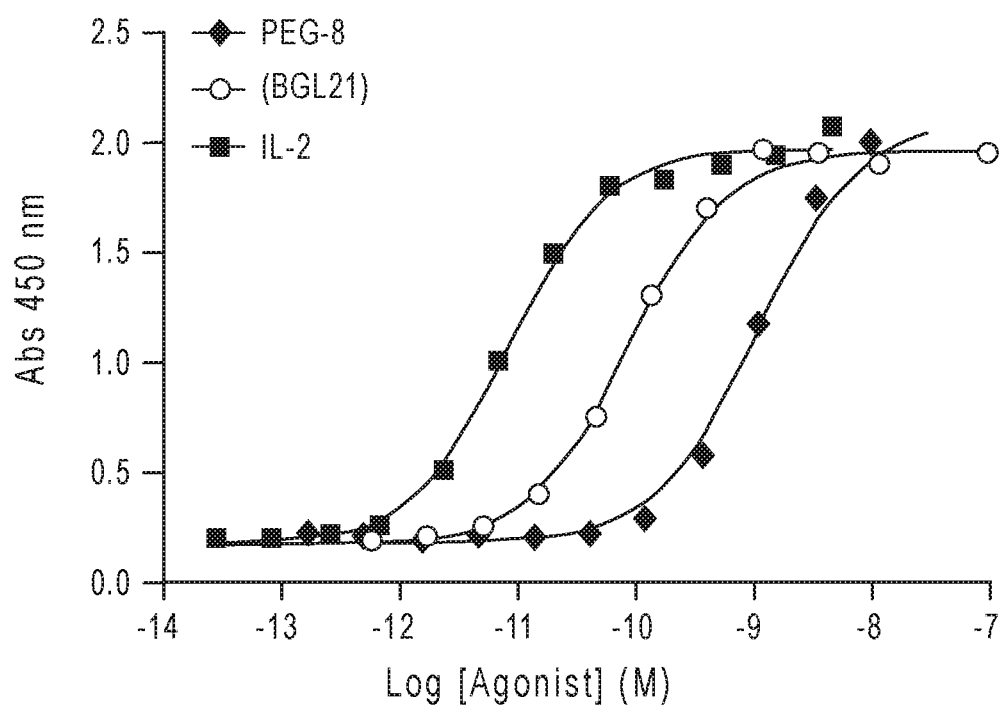
FIG. 18 shows the STAT5 phosphorylation in NK-92 cells following exposure to IL-2, to IL-2Rβγc ligand (BGL21), or to PEGylated IL-2Rβγc ligand (BGL21).
Figure 22A:
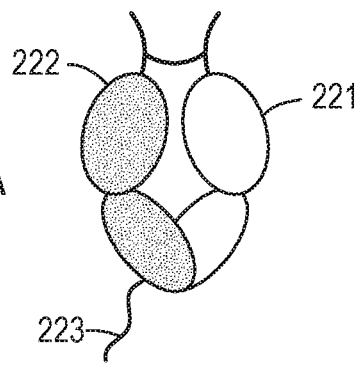
FIGS. 22A-22F show examples of various configurations of IL-2Rβγc ligand fc-fragment fusion proteins provided by the present disclosure.
Figure 22B:
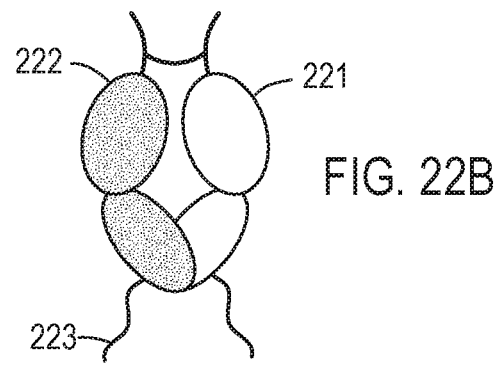
Figure 22C:
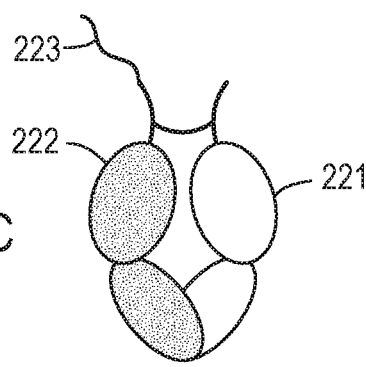
Figure 22D:
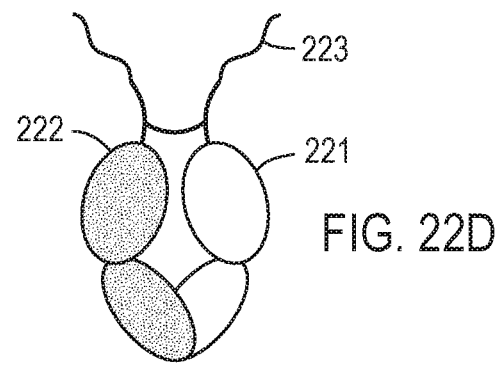
Figure 22E:
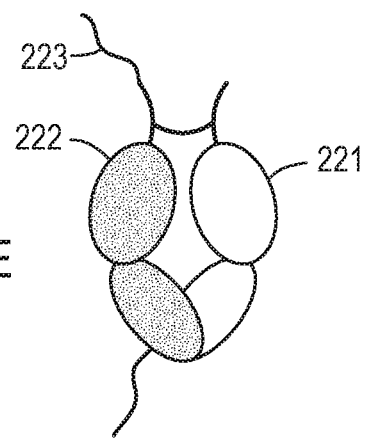
Figure 22F:
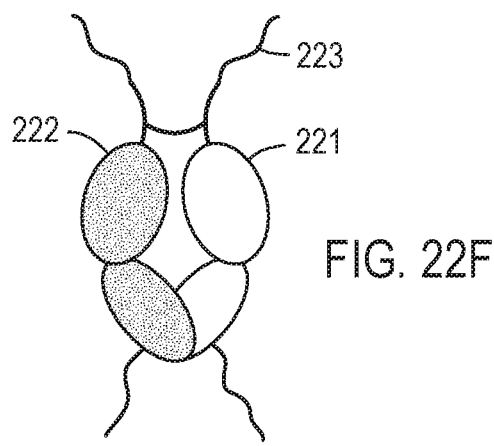
Figure 23A:
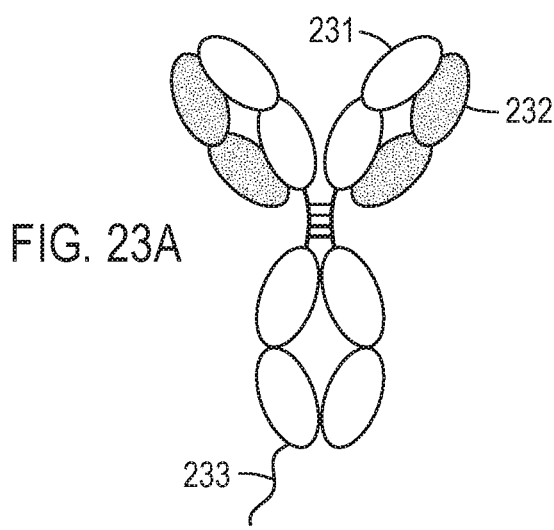
FIGS. 23A-23F show examples of various configurations of IL-2Rβγc ligand immunoglobulin fusion proteins provided by the present disclosure.
Figure 23B:
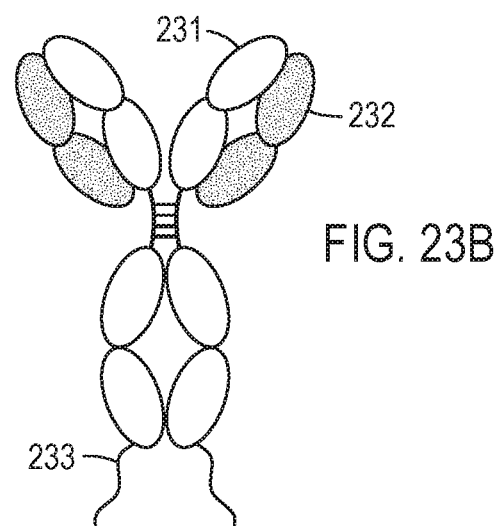
Figure 23C:
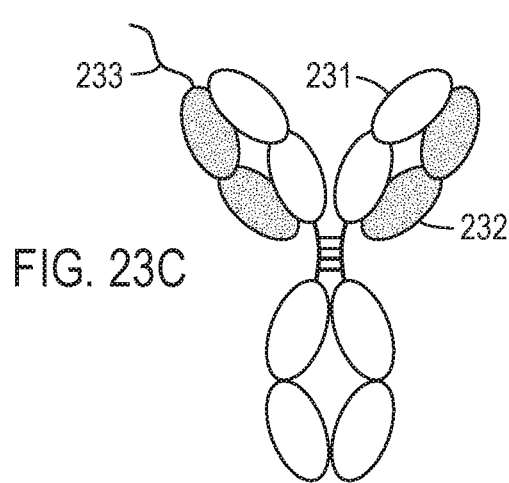
Figure 23D:
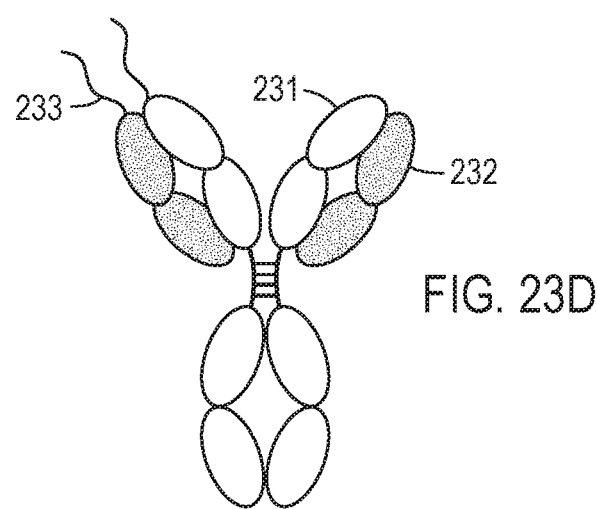
Figure 23E:
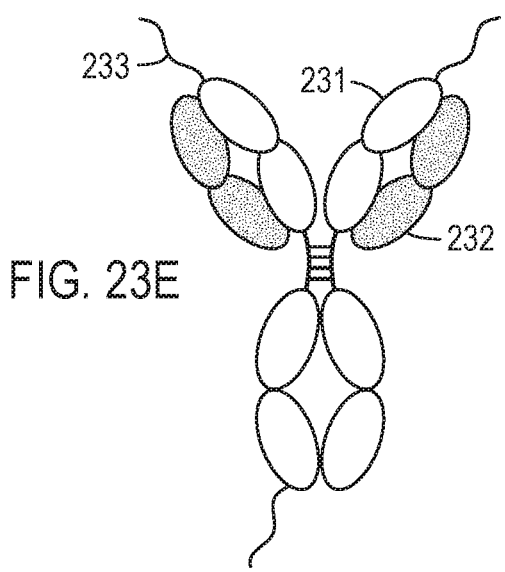
Figure 23F:
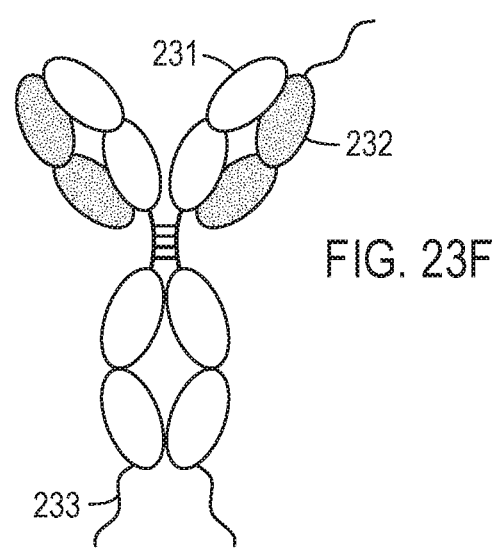

The results are presented in FIG. 18.

Example 23

Production Method

A mammalian cell expression construct was prepared in which the IL-2Rβγc ligand (BGL21) was fused to the C-terminus of a human IgG1 Fc-fragment variant (FP13; SEQ ID NO: 1224). The first cysteine in the hinge region was replaced by a serine to prevent detrimental disulfide bridges and the last amino acid (lysine) was replaced by alanine for fusion stability. An effector silencing mutation was also included in this variant (N297A). A flexible linker $(GS)_{10}$ (SEQ ID NO: 9407) is located between the Fc-fragment and the IL-2Rβγc ligand (BGL21).

Additional mammalian cell expression constructs were prepared in which the IL-2Rβγc ligand (BGL21) was fused to the C-terminus of a human IgG2 Fc-fragment variant in which the first and second cysteines in the hinge region were replaced by serine to prevent detrimental disulfide bridges and the last amino acid (lysine) was replaced by glycine for fusion stability. A flexible linker $(GS)_{10}$ (SEQ ID NO: 0407) (see FP14; SEQ ID NO: 1225) or a rigid linker $(PA)_{10}$ (SEQ ID NO: 9428) (see FP15; SEQ ID NO: 1226) is located between the Fc-fragment and the IL-2Rβγc ligand (BGL21).

Expression plasmids were transfected into CHO-K1 cells and stable pools expressing IL-2Rβγc ligand (BGL21) IgG Fc-fragment fusions were selected in antibiotic containing media. Individual clones were isolated from these pools by limiting dilution and tested for high expression of the IL-2Rβγc ligand (BGL21) IgG Fc-fragment fusion proteins. Large scale cultures of high expressing clones were harvested by centrifugation and the secreted fusion proteins were purified from the supernatants using protein A affinity chromatography. Size exclusion chromatography was used to remove high molecular weight impurities.

Example 24 pH Selective Screening

IL-2Rβ and IL-2Rγc ligands were screened with two peptide libraries to identify peptides exhibiting pH-dependent affinity for the respective receptor subunit. The screening approach utilized cycles of binding and elution under various acidic and neutral pH conditions.

The binding of phage to IL-2Rβ-GPI or IL-2Rγc-GPI was determined using phage ELISA at the two target pH values and the percent change in binding at pH 7.4 relative to binding at pH 6.0 was calculated.

For pH-dependent phage titration, the ELISA screening protocol described in the preceding paragraph was used with the following differences: (1) all 96-well ELISA plates contained IL-2Rβ-GPI target; or IL-2Rγc-GPI target, and (2) the titration of the phage supernatants was prepared in two different PBT pH buffers; pH 6.0 and pH 7.4.

Phage titration was performed in a 96-well polypropylene plate using the following procedure. A 3-times dilution of phage in PBT pH 6 buffer and pH 7.4 buffer was prepared. One hundred (100) µL of the diluted phage were transferred to the target-coated assay plate and incubated at 4° C. for 1 h.

The pH 6.0 wells were washed 3 times with cold PT pH 6.0 and the pH 7.4 wells were washed 2 times with cold PT pH 7.4.

The bound phage were detected with anti-M13-HRP.

Example 25

ELISA Protocol for Biotinylated Peptide pH-Dependent Binding (IL-2Rβ/Fc-Receptor Binding/Multivalent)

For each peptide to be assayed, sixteen (16) ELISA plate wells were coated with neutravidin (10 µg/mL in PBS pH 7.2) at 50 µL/well. The coated wells were incubated at 25° C. for at least 1 h.

The neutravidin was removed from each well. Three hundred (300) µL of blocking buffer (1×PBS pH 7.2, 1% BSA) was added to each well of the neutravidin-coated plates. All plates were covered and maintained at 25° C. for 1 h or overnight at 4° C.

The incubated plates were washed 4 times with PT (1×PBS pH 7.2, 0.05% Tween®20) buffer.

The biotinylated peptides were diluted to 1 µM in PBT pH 7.2 buffer and 50 µL was added to the appropriate 16 wells (8 for each binding pH). The plates were incubated at 25° C. for at least 1 h.

Two (2) titrations of IL-2Rβ-Fc protein were prepared in a polypropylene plate starting at 2 µg/mL using PBT pH 6.0 and pH 7.4 and diluting 3-fold.

The plates were washed 4-times with PT (1×PBS pH 7.2, 0.05% Tween®20) buffer.

Fifty (50) µL of the IL-2Rβ-Fc protein dilutions were added to the assay plates buffered at pH 6.0 or pH 7.4) and incubated for 1 h at 4° C.

The incubated plates were washed 3-times with the corresponding pH buffer PT (50 mM PBS pH 6.0, 0.05% Tween®20 or 50 mM PBS pH 7.4, 0.05% Tween®20).

Fifty (50) µL of goat anti-huIgG-HRP diluted 1:2500 in cold PBT pH 6.0 was added to each well. The plates were then incubated for 1 h at 4° C. The plates were then washed 4 times with cold buffer PT pH 6.0. Fifty (50) µL of TMB was then added to each well, and the wells were incubated for 1-10 min at 25° C. Fifty (50) µL of a "stop" solution was added to each well, and the plates were read at 450 nm.

Example 26

STAT5 Phosphorylation in NK-92 Cells with IL-2Rβγc Ligands Having a pH-Biased IL-2Rβ Ligand The IL-2R agonist activity of a pH-biased IL-2Rβγc ligand comprising an IL-2Rβ ligand with a pH-biased affinity for IL-2Rβ was evaluated using a STAT5 phosphorylation assay in NK-92 cells.

The IL-2Rβγc ligand was incubated with NK-92 cells and STAT5 phosphorylation measured as a function of concentration using the methods described in Example 4 where the starvation media was adjusted to either pH 6.0 or pH 7.4.

Figure 24:
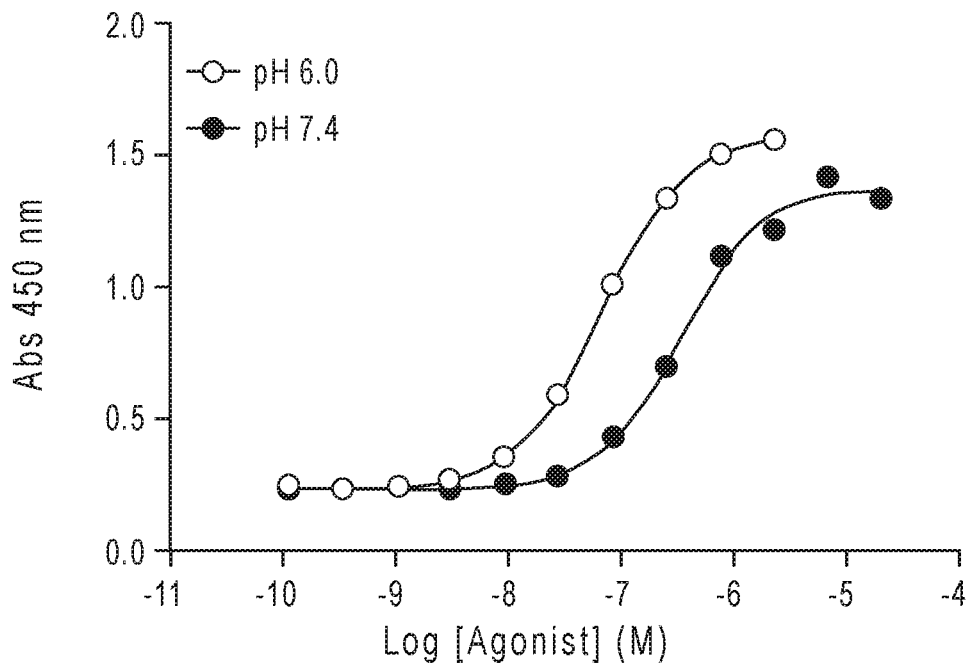
FIG. 24 shows the STAT5 phosphorylation in NK-92 cells following exposure to a pH-biased IL-2Rβγc ligand at pH 6.0 and at pH 7.5.

The results are presented in FIG. 24.

Example 27

Competition ELISA Protocol for IL-2Rβ Ligand pH-Biased Binding

For each peptide to be assayed, sixteen (16) ELISA plate wells were coated with IL-2Rβ-Fc (50 ng/well) for at least 1 h at 25° C. or overnight at 4° C.

The IL-2Rβ-Fc was removed from each well. Three hundred (300) μL of blocking buffer (1×PBS pH 7.2, 1% BSA) was added to each well of the IL-2Rβ-Fc-coated plates. All plates were covered and maintained at 25° C. for at least 1 h.

The incubated plates were washed 3-times with PT (1×PBS pH 7.2, 0.05% Tween®20) buffer.

A pH-biased IL-2Rβγc ligand having a pH-biased IL-2Rβ ligand was diluted to 2-times final concentration (20 μM) in PBT pH 6.0 and pH 7.2 buffer and 50 μL was added to the appropriate 16 wells (8 for each binding pH). The plates were then incubated at 4° C. for 1 h.

A biotinylated version of a peptide ligand that is competitive with the test peptide an in which the binding affinity is the same at pH 6.0 and 7.4, was combined with a neutravidin-HRP conjugate for at least 45 min to prepare the peptide-HRP complex, which was then diluted in pH 6.0 or pH 7.4 PBT.

Without washing, fifty (50) μL of the peptide-HRP complex dilutions were added to the assay plates buffered at pH 6.0 or pH 7.4 and incubated for 1 h at 4° C.

The incubated plates were washed 3-times with the corresponding pH buffer PT (50 mM PBS pH 6.0, 0.05% Tween®20 or 50 mM PBS pH 7.4, 0.05% Tween®20).

Figure 25:
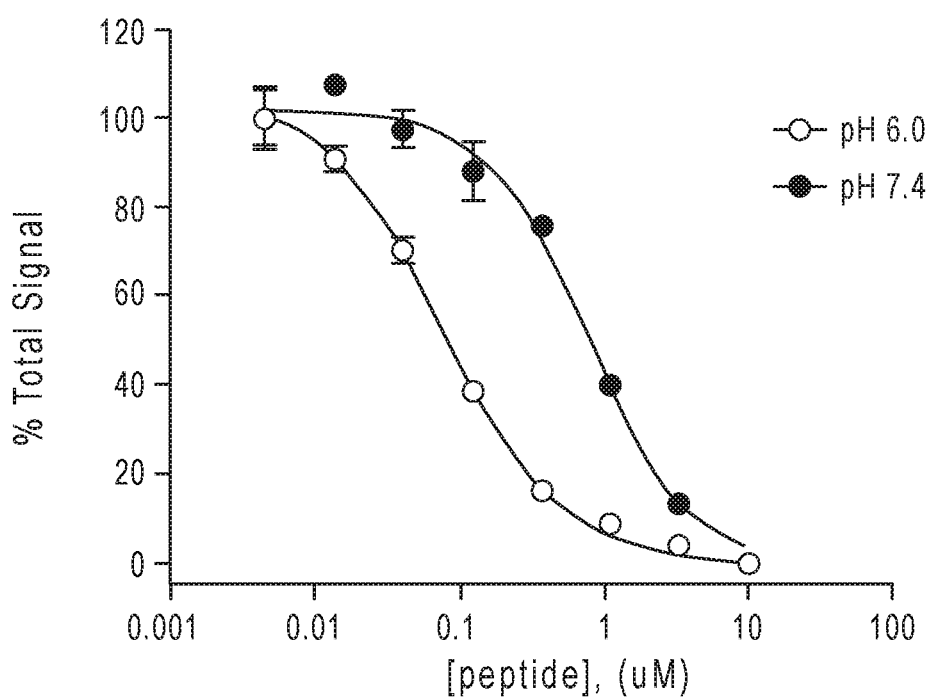
FIG. 25 shows the normalized ELISA signal for competitive binding of a pH-biased IL-2Rβγc ligand at pH 6.0 and pH 7.4 to the IL-2Rβ subunit.

Fifty (50) μL of TMB (3,3'5,5'-tetramethylbensidine) was then added to each well, and the wells were incubated for from 1 to 15 min at 25° C. Fifty (50) μL of a stop solution was added to each well, and the plates were read at 450 nm. The results are presented in FIG. 25.

Example 28

Competitive Binding

Competitive binding assays were performed to characterize the IL-2R binding site for IL-2Rβ ligands, to IL-2Rγc ligands, and to IL-2Rβγc ligands.

For IL-2Rβ ligands, representative phage clones displaying peptides from IL-2Rβ ligand families were bound to the extracellular domain (ECD) of the IL-2Rβ subunit immobilized in microtiter wells. Phage binding was conducted in the presence and absence of synthetic test peptides to determine if phage peptides and test peptides competed for binding to the same sites on IL-2Rβ. Synthetic test peptides were selected to represent peptides from IL-2Rβ ligand families, as well as positive and negative control peptides. IL-2Rβ ligand family sequences and the specific IL-2Rβ ligands evaluated are provided in Table 13.

The IL-2Rβ ligands bound to the IL-2Rβ subunit with an $IC_{50}$ of less than 10 μM and bound to the IL-2Rγc subunit with an $IC_{50}$ of greater than 100 μM.

Phage binding to the immobilized IL-2Rβ ECD was detected by staining with antibody against phage coat proteins (anti-phage Ab), staining with labeled secondary antibody against the anti-phage Ab, and scored by reading OD in the microtiter plate optical reader.

The ELISA signal for each phage binding in the presence and absence of the test peptides was compared to determine which synthetic peptides competed with which phage peptides for binding to the IL-2Rβ subunit. The peptide pairs that exhibited competitive binding (i.e., cross inhibition) were considered to bind at the same functional site on the IL-2 receptor. The results are presented in Table 14.

TABLE 14

Binding of IL-2Rβ ligands to IL-2R.

| IL-2Rβ Ligand | | Phage Clone | | | | |
|---|---|---|---|---|---|---|
| SEQ ID NO: | | 58 | 170 | 83 | 1034 | 1044 |
| IL-2Rβ Ligand SEQ ID NO: | IL-2β Family | 1 | 2A | 2B | 2C | 4 |
| 58 | 1 | +[1] | + | + | + | − |
| 169 | 2A | + | + | + | + | − |
| 1042 | 2C | + | + | + | + | − |
| 1044 | 4 | −[2] | − | − | − | + |
| 224 | 11-2Rγc Ligand | − | − | − | − | − |

[1]IL-2Rβ ligand competes with phage binding.
[2]IL-2Rβ ligand does not compete with phage binding.

The IL-2Rβ ligands did not bind competitively to the binding site of the IL-2Rβ subunit with IL-2.

A similar study was performed to evaluate the binding of IL-2Rγc ligands. IL-2Rγc ligand family sequences and the specific IL-2Rγc ligands evaluated are provided in Table 15.

TABLE 13

IL-2Rβ ligand families and ligands.

| IL-2Rβ Ligand Family | Specific IL-2Rβ SEQ ID NO: | Peptide Sequence | | | | | | | | | | | |
|---|---|---|---|---|---|---|---|---|---|---|---|---|---|
| 1 | 58 | Y | D | C | R | I | A | Q | V | G | E | L | C | D | L |
| 2A | 169 | N | M | C | L | V | G | D | Y | W | P | S | C | Q | I |
| 2A | 170 | Q | I | C | D | V | G | Q | W | W | P | D | C | Q | V |
| 2B | 83 | C | C | Y | Q | A | M | V | G | D | L | C | D | F | C |
| 2C | 1034 | C | G | M | A | I | G | D | L | C | M | W | T | | |
| 2C | 1042 | R | W | G | D | V | G | D | L | L | M | P | L | | |
| 4 | 1044 | R | S | C | Y | Y | K | R | P | R | L | W | C | S | E |
| IL-2Rγc Ligand | 224 | D | C | S | M | W | E | G | V | E | L | C | W | | |

TABLE 15

IL-2Rγc ligand families and ligands.

| IL-Rγc Ligand Family | Specific IL-2Rγc SEQ ID NO: | Peptide Sequence |
|---|---|---|
| 1A | 198 | K V C E M W G G V L L C W N |
| 1A | 202 | R T C T E W E N V V L C W V |
| 1B | 224 | D C S M W E G V E L C W |
| 2 | 236 | M C W L E W G E W V G S C L |
| 3 | 248 | D L S D L S T F W L S Q |
| 4 | 266 | C P S M L Q G P E T Y W V C |
| 5 | 1032 | S L L K C Y N A S Y C S S V F |
| IL-2Rβ Ligand | 58 | Y D C R I A Q V G E L C D L |

The IL-2Rγc ligands bound to the IL-2Rγc subunit with an $IC_{50}$ of less than 10 μM and bound to the IL-2Rβ subunit with an $IC_{50}$ of greater than 100 μM.

The results of the competitive binding assay are presented in Table 16.

TABLE 16

Binding of IL-2Rγc ligands to IL-2R.

| IL-2Rγc Ligand SEQ ID NO: | IL-2Rγc Ligand IL-2Rγc Family | Phage Clone |  |  |  |  |  |
|---|---|---|---|---|---|---|---|
|  | SEQ ID NO: | 198 | 224 | 236 | 248 | 266 | 1032 |
|  | IL-2Rγc Family | 1A | 1B | 2 | 3 | 4 | 5 |
| 202 | 1A | +[1] | + | + | + | + | − |
| 224 | 1B | + | + | + | + | + | − |
| 236 | 2 | + | + | + | + | + | − |
| 248 | 3 | + | + | + | + | + | − |
| 1032 | 5 | −[2] | − | − | − | − | + |
| 58 | IL-2Rβ Ligand | − | − | − | − | − | − |

[1]IL-Rγc ligand competes with phage binding.
[2]IL-Rγc ligand does not compete with phage binding.

Example 29

Agonist Activity of PEG-IL-2Rβγc Ligand Constructs

PEG-IL-2Rβγc ligand constructs were synthesized as described in Example 21. The structures of the PEG-IL-2Rβγc ligand constructs is shown in FIGS. 27-33. The IL-2Rβγc ligand used for each of the constructs had SEQ ID NO: 1263. The PEG constructs were incubated with NK-92 cells and STAT5 phosphorylation was measured as a function of concentration using the methods described in Examples 3 and 4, respectively.

The results are presented in Table 17.

TABLE 17

Agonist activity of PEG-IL-2Rβγc ligand constructs.

| Construct | PEG attachment terminus | PEG size | PEG/peptide linker | PEG structure | IL-2Rβ IC50 | IL-2Rγc IC50 | EC50 (STAT5, NK92) |
|---|---|---|---|---|---|---|---|
| PEG-1 | N− | 40kD | [1]PEG10 | branched | 31 nM | 26 nM | 5.8 nM |
| PEG-2 | C− | 40kD | [1]PEG4 | branched | 8 nM | 690 nM | 273 nM |
| PEG-3 | N− | 40kD | (AP)6 (SEQ ID NO: 9432) | branched | 14 nM | 4.3 nM | 2.3 nM |
| PEG-4 | C− | 40kD | [1]PEG10 | branched | 8.5 nM | 3.7 nM | 24 nM |
| PEG-5 | N− | 20kD | [1]PEG20 | linear | 33 nM | 4.1 nM | 1.0 nM |
| PEG-6 | N− | 40kD | [1]PEG20 | linear | 17 nM | 3.4 nM | 1.6 nM |
| PEG-7 | N− | 40kD | [1]PEG20 | branched | 3.4 nM | 1.7 nM | 8.3 nM |

[1]Incorporated as Fmoc-NH—(PEG$_n$)—CH$_2$CH$_2$—COOH, where n = 4, 10, or 20.

Example 30

IL-2Rβγc PEG-Peptide Agonist PK Analysis in CD-1 Mice

A pharmacokinetic study of an IL-2Rβγc PEG-peptide agonist was performed in CD-1 male mice. An IL-2Rβγc PEG-peptide agonist (PEG-6) was administered intravenously with a single dose of 1 mg/kg to each mouse (n=5). Blood samples were collected at 0 h (pre-dose), 1, 2, 6, 24, 48, 72 and 96 h post-dosing into serum separator vials. Samples were centrifuged at 10,000×g for 5 min at 4° C. and the serum transferred to a new tube. Samples were frozen and stored at −80° C. prior to testing.

The TF-1β STAT5 phosphorylation bioassay as described in Example 3 was used to quantify the amount of PEG-6 present in each of the serum samples. Three-fold serial dilutions of each serum sample or a compound reference standard in starvation media were added to the cells and incubated for 30 mins with the cells. Cells extracts were prepared and the quantity of phosphorylated STAT5 was determined as described in Example 3. The PEG-6 concentration in each serum sample was calculated using a standard curve generated from the reference standard.

Figure 26:
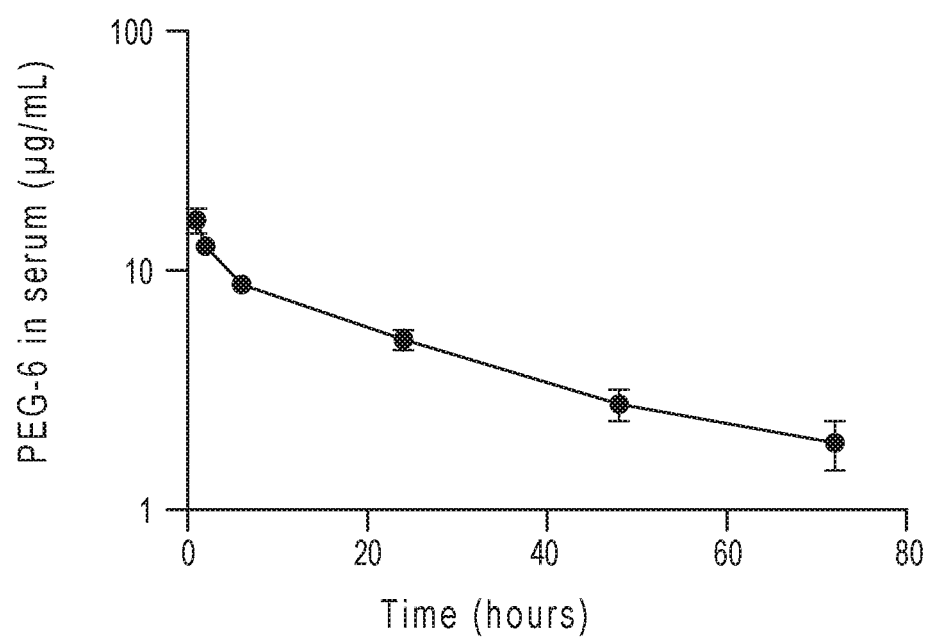
FIG. 26 shows a PK profile of a PEG-IL-2Rβγc ligand construct (PEG-1) following administration to mice.
Figure 27:
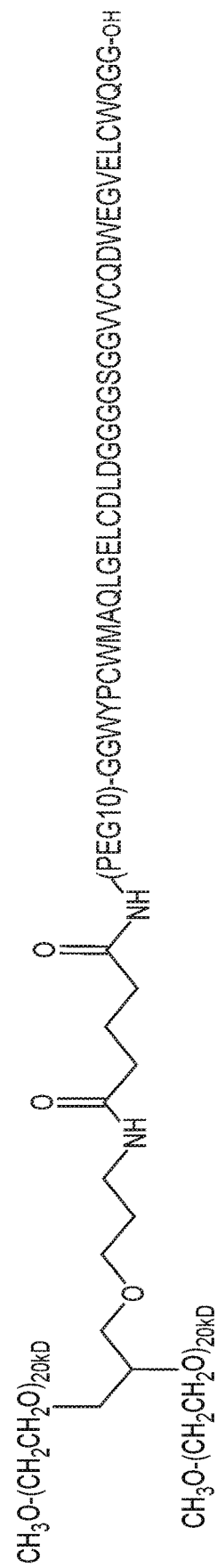
FIGS. 27-33 show examples of PEG-IL-2Rβγc ligand constructs PEG-1 to PEG-7, respectively. The IL-2Rβγc ligand has SEQ ID NO: 1263.
Figure 28:
Figure 29:
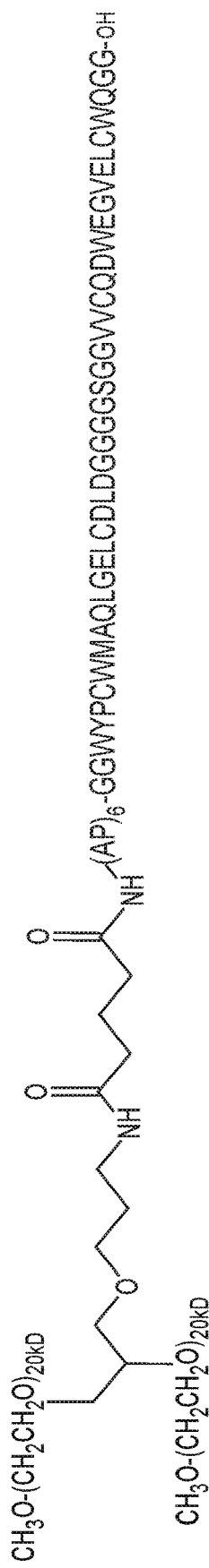
Figure 30:
Figure 31:
Figure 32:
Figure 33:

The results are presented in FIG. 26.

Example 31

Phage Display pIII Library Panning Against Fc-Receptor Fusions on Magnetic Beads (Acid Elution) Library Panning Procedure The following protocol or similar protocol was used to screen peptides for binding to the hIL-2Rβ and the hIL-2Rγc subunits and for some peptides to the cyno-IL-2Rβ and the cyno-IL-2Rγc subunits.

Fifty (50) μL of Protein G Dynabeads® (Invitrogen) was used for each library sample. After resuspending the stock bottle, the desired volume of beads was transferred to a sterile microfuge tube and applied to the magnet.

With the beads on a magnet, the supernatant was removed, and the beads were washed with 1 mL of PT buffer (1×PBS, 0.05% Tween®20).

The supernatant was removed and 1 mL of PBS+1% BSA+0.05% Tween®20 was added and mixed at 25° C. for at least 1 hour to block the beads.

A tube was applied to the magnet and the blocking solution was removed. For each library to be tested, 5 μg of a Fc-fused receptor of interest was added to each library sample for each round to bring the total volume to at least 400 μL. The samples were mixed at 25° C. for at least 1 h. The sample was applied to the magnet and the supernatant was removed.

Two-hundred 200 μL of PT buffer was added for each 50 μL of bead. The sample was thoroughly mixed and 200 μL aliquots were transferred into tubes that were pre-labeled for each library to be screened. An additional 500 μL of PT was added to each tube, the samples mixed, and then applied to the magnet. A total of 700 μL/tube was used for the wash.

One (1) mL aliquots of the libraries removed from the −20° C. freezer. One hundred (100 μL of 10× BT buffer (5% BSA, 0.5% Tween®20 in 1×PBS) was added to each tube and vortexed. The library samples were transferred to pre-labeled tubes containing beads. The samples were then incubated at 4° C. on the rotator for at least 2 h. For the additional rounds of screening, 1 mL aliquots of the amplification from the previous round from each library was used. The beads were recovered with the magnet and the phage solution removed. The beads were washed 2× with 1 mL of PT buffer. Five hundred (500) μL of PT buffer was added and the suspension was transferred to a clean tube. The beads were recovered on the magnet and the final wash removed.

Four-hundred seventy-five (475) μL of phage elution buffer was added to each well (0.2 M glycine-HCL, pH 2.2, 1.0 mg/mL BSA). The samples were incubated at 25° C. for 10 min on the rotator. The beads were recovered on the magnet and the eluted phage transferred to a clean tube.

Twenty-five (25) μL of neutralization buffer (2 M Tris Base) was added to the 475 μL of elution. The neutralized samples were maintained at 4° C. until the TG1 cells were ready amplification. The samples were stored at −20° C. after screening. Fifty (50) μL (about 10% of the total volume) was transferred to a 1.5 mL microfuge tube and store at −20° C. for use in deep sequencing.

Example 32

TG1 Culture and Library Amplification

A fresh TG1 (or OmniMax) culture was grown for about 1 to 1.5 h after adding the libraries to the beads. 2X-YT medium (10 mL) was placed into a 50 mL Falcon® tube. Two hundred (200) μL of the TG1 overnight was added to the falcon tube. 2X-YT medium (600 μL) was placed in a cuvette for OD600 blank. The culture was grown at 250 rpm and 37° C., taking the first OD measurement after 60 min. The TG1 cells should be in log phase at the time of use with an OD600 of 0.5-0.7.

Eluted phage (400 μL to 450 μL) was added to 1.0 mL of the TG1 cells at an OD600 of 0.5-0.7 in a 50 mL Falcon® tube. The phage and TG1 cells were incubated at 37° C. for 30 min without shaking. About 50 μL to 100 μL was set aside for titering and characterization.

2YT medium (10.5 mL) was added to 12 μL of carbenicillin (carb) (100 mg/mL to make 100 μg/mL) and 24 μL of 50% glucose (to make 0.1% glucose) and the cells incubated while shaking at 37° C. at 250 rpm for 1 h.

M13K07 helper phage ($5 \times 10^{10}$ pfu, 24 μL of the stock, $2 \times 10^2$ pfu/mL) was then added and swirled to mix. The phage and cells were incubated at 37° C. for 30 min without shaking.

Kanamycin was diluted to 3 mg/mL and arabinose to 2.4% in 2YT medium/Carbenicillin-100/0.1% glucose and 100 μL was added to each amplification. The mixture was incubated overnight at 37° C. and 250 rpm.

The culture was transferred to a 50 mL high-speed VWR centrifuge tube and centrifuged at 8,000 g for 15 min at 4° C. in a JSP-F50C centrifuge to pellet the cells.

The supernatant was transferred to a 50 mL high-speed VWR centrifuge tube and 0.2 volumes of PEG/NaCl (multiply the volume by 0.25 mL to 3 mL PEG/NaCl for 12 mL amplification) was added, mixed, and incubated on ice for 30 minutes.

The cells were then centrifuge at 10,500 g for 15 min at 4° C. in a JSP-F50C centrifuge. The supernatant was removed, and the phage pellet was resuspended in a total of 1 mL of PBT (1×PBS, 0.05% Tween®20, 0.5% BSA) by pipetting.

The sample was transferred to an Eppendorf tube, vortexed, and centrifuged at 12,000 rpm for 30 sec. The supernatant was transferred to a clean Eppendorf tube and stored at 4° C. This amplified phage sample (250-500 μL) was used for the next round of screening.

Example 33

Preparation of Cultures from Individual Colonies

Ninety-six (96) wells of a deep well plate were filled with 1 mL of 2YT broth/Ampicillin-50/0.1% glucose. Ninety-six (96) colonies were placed into the wells using P20 tips. The tips were left in the wells to mark the position. The tips were removed using a multi-channel pipette after the entire plate was completed. The plate was covered with a breathable film.

The inoculated plate(s) were incubated in a shaker at 37° C. until the cultures became turbid, typically within 4 h at 250 rpm.

The plate(s) was removed from the incubator and 50 μL of the culture from each well was removed to another deep well block designated as the "Archive Block" containing 1 mL of 2YT broth/Ampicillin-50/0.1% glucose. The plate(s) were covered with a breathable film and incubated overnight at 37° C. and 250 rpm.

After incubating overnight, M13K07 helper phage was added to $2\times10^{10}$ pfu/mL in 2YT broth/Ampicillin-50/0.1% glucose (make 6.0 mL per block). Fifty (50) μL of the diluted M13K07 was added to each culture well in the deep well block. The deep well block was covered with breathable film and incubated for 30 min at 37° C. and 250 rpm.

Kanamycin was diluted to 0.5 mg/mL and arabinose to 0.4% in 2YT broth/Ampicillin-50/0.1% glucose (make 6.0 mL per block) and 50 μL was added to each well. The plate was covered with a breathable film and incubated overnight at 37° C. and 250 rpm.

The "Archive Block" culture was removed from the incubator and 50 μL was transferred to a 96-well plate containing 50 μL of 50% glycerol. The plate was sealed with foil and stored at −80° C. The remaining culture in the block was covered with a foil seal and stored at 4° C.

The block was centrifuged and inoculated with M13K07 at 4000 rpm for 15 min. While avoiding the bacterial pellet, 850 μL of the phage supernatant was transferred to a fresh deep well plate, covered with a foil seal, and stored at 4° C.

Example 34

ELISA Protocol for Fc-Fusions

For each block to be assayed, a 1×96 well ELISA plate was coated with Fc-fusion (1 μg/mL in PBS) at 50 μL/well. The wells were incubated at 25° C. for at least 1 h.

The Fc-fusion was removed from each well. Three hundred (300) μL of blocking buffer (1×PBS, 1% BSA) was added to each well of a receptor-coated plate. Also, 300 μL of the blocking buffer was added to a separate uncoated 96-well ELISA plate to be used as the negative control. Both plates were covered with film and left at 37° C. for 1 h or overnight at 4° C.

The plate was washed 4 times with PT (1×PBS, 0.05% Tween® 20) buffer. Fifty (50) μL of PBT was added to each well. Fifty (50) μL of the phage supernatant from the block was added to each well and incubated at 4° C. for 1 h. The plates were washed 4 times with cold PT. To each well 100 μL of anti-M13-HRP antibody diluted 1:5000 in cold PBT was added. The wells were incubated for 1 h at 4° C.

The plates were then washed 4 times with cold PT. Fifty (50) μL of TMB was then added to each well, and the wells were incubated for 1-10 min at 25° C. Fifty (50) μL of a "stop" solution was added and the plate read at 450 nm.

Example 35

Evaluation of Peptide Heterodimer Ability to Dimerize IL-2Rβγc and to Activate IL-2 Responsive Cells Following the identification of peptidyl ligands that exhibit IL-2Rβ and IL-2Rγc binding activity, compounds will be identified that exhibit IL-2R agonist activity. This will involve assessing the ability of the peptide to dimerize the IL-2Rβγc subunits and to signal in cell-based assays. Dimerization is a necessary, but not sufficient, step in the activation of receptor signaling. To assess agonist activity in cell-based assays, IL-2 responsive cell lines will be tested for an indicator of IL-2 signaling, phosphorylation of STAT5. Compounds that exhibit IL-2Rβγc agonist activity in these cell lines will then be tested in primary human peripheral blood mononuclear cells (PBMC) for IL-2R agonism, and for the desired selectivity favoring activation of cell types expressing IL-2Rβγc subunits, but with low or no IL-2Rα (CD25) subunit expression.

Dimerization potential will be assessed using a β-Gal complementation system in which a portion of the intracellular domains of each respective IL-2 receptor subunit is replaced with functionally complementary fragments of β-Gal, which regain catalytic activity when brought into sufficiently proximity. Cells expressing these constructs generate β-Gal activity, with an ED50 of about 26 nM, when treated with IL-2 (see DiscoverX product specifications). All synthetic, potentially agonist, peptides will be tested using this assay.

Candidate compounds will be scored for induction of STAT5 phosphorylation in two cell lines: (1) CTLL-2 cells, a mouse cytotoxic T-lymphocyte line that expresses all three IL-2 receptor subunits, and which are responsive to IL-2Rβγc-biased variants as well as wild type IL-2; and (2) TF-1β cells which are derived from the human erythroleukemia line TF-1, and naturally express only IL-2Rγc, and are engineered to be IL-2 responsive by transfection of IL-2Rβ. TF-1β will be constructed and IL-2R subunit expression levels in both cell lines will be verified by QPCR and FACS analysis.

Compounds will be tested in both cell lines. Dose response assays will be conducted to determine EC50 of the test compounds and to compare the test compounds with IL-2 as an indicator of IL-2Rβγc receptor bias. To further characterize subunit bias, a parallel assay will be run in the presence of a neutralizing antibody to the human IL-2Rβ subunit.

As a control to confirm that positive compounds are acting through stimulation of the IL-2 receptor, the assay will also be done with cells treated with neutralizing anti-huIL-2Rβ antibody. To determine that compound activity is not due to contamination with cytokines, test compounds will be treated with neutralizing antibodies (R&D Systems) against the natural IL-2Rβγc agonists, IL-2 and IL-15.

Compounds exhibiting IL-2R agonist activity in the cell lines will be tested on human primary immune cells, PBMCs, collected from individual donors (commercially available from Lonza), and in some cases on purified CD4+ cells (Lonza). A substantial fraction of PBMCs from normal donors are responsive to IL-2. To assess IL-2 agonist activity of the test compounds, cells will be exposed to the compounds or IL-2 and scored for STAT5 phosphorylation by western blot analysis. As a control to confirm that positive compounds are acting through stimulation of the IL-2 receptor, the assay will also be done with cells treated with neutralizing anti-huRβ antibody.

Those compounds exhibiting STAT5 activation of PBMCs will be subjected to a follow-on assay designed to assess subunit bias of the compounds compared to IL-2. This assay will involve determining a dose response of the test compounds and IL-2 (1 to 1000 IU) over 30 min, scored by a FACS-based protocol allowing detection of both intracellular pSTAT5 as an indicator of IL-2R activation, and cell surface CD25, the IL-2Rβ subunit. Cells expressing the three IL-2R subunits, IL-2Rβγc, bind IL-2 with very high affinity (about 10 μM) and are therefore sensitive to low concentrations of IL-2; whereas cells expressing only IL-2Rβγc (about 1 nM affinity) require exposure to substantially higher IL-2 levels for activation. Because compounds provided by the present disclosure are selected for binding to the IL-2Rβ and IL-2Rγc subunits, but not to IL-2Rα, the potency of the compounds is expected to be uncorrelated with the level of expression of IL-2Rα on cells; and comparison of response profiles of cells treated with compounds provided by the present disclosure or treated with IL-2 should reveal any bias.

Example 36

Identified Peptides

Stochastic libraries with each library containing approximately $10^{10}$ independent recombinants, with each clone potentially displaying a unique peptide sequence have been screened for binding to human IL-2R or to human Il-2Rγc subunits.

Example 36

Preparation of NK-92 Cells for Testing STAT5 Activation of hIL-2R

NK-92 cells were seeded in a 24-well plate at $4 \times 10^5$ cells, in 1 mL starvation medium (SM), and incubated overnight at 37° C., 5% $CO_2$. The starvation medium contained RPMI 1640+20% FBS+2 mM L-glutamine+1 mM NaPyr+10 mM HEPES+0.1 mM BME (no rhIL-2 supplement).

Treatment mixtures were of 1 μg/mL Anti-hIL-2 neutralizing antibody (0.2 mg/mL stock) or goat IgG control (1 mg/mL stock) were prepared.

The treatment mixtures and the antibody mix were added to the cells for 30 min at 37° C., 5% $CO_2$. Each sample was then transferred to a 1.5 mL microfuge tube and spun down at 1,500 RPM for 5 minutes. The cells were washed in 1 mL PBS and centrifuged again.

A phosphatase and protease inhibitor cocktail (Thermo #78442) were added to mPER buffer at a 1:100 dilution. After the cells were pelleted, 50 μL of mPER buffer was added to each sample and pipetted repeatedly to homogenize.

The lysates were centrifuged at 14,000 RPM for 5 min at RT. The supernatants were transferred to clean tubes and stored frozen at −80° C.

The human IL-2 Antibody (goat IgG) was obtained from R&D Systems No. AF-202-NA; the normal goat IgG Control was obtained from R&D Systems No. AB-108-C; the Anti-STAT5 Antibody (rabbit), the Cell Signaling No. 94205S, the Anti-pSTAT5 Antibody (rabbit), the Cell Signaling No. 4322S, and the Goat anti-rabbit IgG-HRP was obtained from Jackson Immunoresearch No. 111-035-144.

The antibodies, treatment and working stock prep for each of the samples is provided in Table 18. Compounds A and B are IL-2Rβγc agonists provided by the present disclosure.

TABLE 18

STAT5 activation samples in NK-92 cells.

| No. | Antibody | Vol (μL) | Treatment | Vol (μL) | Working stock prep |
|---|---|---|---|---|---|
| 1 | Anti-hIL-2 IgG | 5 | A 10 μM | 100 | 100 μM (1:100 of 10 mM stock in SM) |
| 2 | Anti-hIL-2 IgG | 5 | A 1 μM | 10 | 100 μM (1:100 of 10 mM stock in SM) |
| 3 | Anti-hIL-2 IgG | 5 | A 0.1 μM | 1 | 100 μM (1:100 of 10 mM stock in SM) |
| 4 | Anti-hIL-2 IgG | 5 | B 10 μM | 100 | 100 μM (1:100 of 10 mM stock in SM) |
| 5 | Anti-hIL-2 IgG | 5 | B 1 μM | 10 | 100 μM (1:100 of 10 mM stock in SM) |
| 6 | Anti-hIL-2 IgG | 5 | B 0.1 μM | 1 | 100 μM (1:100 of 10 mM stock in SM) |
| 7 | Anti-hIL-2 IgG | 5 | rh-IL2 1 ng/mL | 10 | 100 ng/mL (1:1000 of 100 μg/mL stock in SM) |
| 8 | Anti-hIL-2 IgG | 5 | rhIL-2 0.1 ng/mL | 1 | 100 ng/mL (1:1000 of 100 μg/mL stock in SM) |
| 9 | Anti-hIL-2 IgG | 5 | rhIL-2 0.1 ng/mL + 1% DMSO | 1 | 100 ng/mL (1:1000 of 100 μg/mL stock in SM) + 10 μL DMSO |
| 10 | Anti-hIL-2 IgG | 5 | Starvation Medium (SM) | N/A | N/A |
| 11 | Goat IgG control | 1 | A 10 μM | 100 | 100 μM (1:100 of 10 mM stock in SM) |
| 12 | Goat IgG control | 1 | A 1 μM | 10 | 100 μM (1:100 of 10 mM stock in SM) |
| 13 | Goat IgG control | 1 | A 0.1 μM | 1 | 100 μM (1:100 of 10 mM stock in SM) |
| 14 | Goat IgG control | 1 | B 10 μM | 100 | 100 μM (1:100 of 10 mM stock in SM) |
| 15 | Goat IgG control | 1 | B 1 μM | 10 | 100 μM (1:100 of 10 mM stock in SM) |
| 16 | Goat IgG control | 1 | B 0.1 μM | 1 | 100 μM (1:100 of 10 mM stock in SM) |
| 17 | Goat IgG control | 1 | rh-IL2 1 ng/mL | 10 | 100 ng/mL (1:1000 of 100 μg/mL stock in SM) |
| 18 | Goat IgG control | 1 | rhIL-2 0.1 ng/mL | 1 | 100 ng/mL (1:1000 of 100 μg/mL stock in SM) |
| 19 | Goat IgG control | 1 | rhIL-2 0.1 ng/mL + 1% DMSO | 1 | 100 ng/mL (1:1000 of 100 μg/mL stock in SM) + 10 μL DMSO |
| 20 | Goat IgG control | 1 | Starvation Medium (SM) | N/A | N/A |

The samples were applied to a Western Blot. The treatment reagents included Anti-STAT5 Antibody (rabbit), Cell Signaling No. 94205S; Anti-pSTAT5 Antibody (rabbit), Cell Signaling No. 4322S; and Goat anti-rabbit IgG-HRP, Jackson Immunoresearch No. 111-035-144.

To perform the assay, NK-92 cells were plated in starvation medium at 20,000 cells/well in a 96-well plate. Treatment was added to each well in 3-fold serial dilutions with the peptides having maximum concentration of 10 µM and rhL-2 having a maximum concentration of 6.67 nM. The cells were then incubated at 37° C. for 48 h. CellTiter-Glo® reagent was added and the cells incubated for 10 min at 25° C. before luminescence reading.

Example 37

Preparation of TF-1β and TF-1 Cells for Testing STAT5 Activation of hIL-2R

TF-1β and TF-1 parental cells were counted. The cells were collected and $2.5 \times 10^6$ cells pelleted at 200×g for 5 minutes. The pelleted cells were washed with 25 mL RPMI with no additives.

The TF-1β and TF-1 parental cells were seeded at $5 \times 10^5$ cells in a T25 flask, in 5 mL starvation medium (SM), and incubated overnight with the flask upright at 37° C. under 5% $CO_2$.

The TF-1β and TF-1 parental cells were counted, and the viability was determined. If necessary, the cells were diluted to $5 \times 10^5$ cells/mL in SM and then 1 mL of the suspension was added to 6 wells/cell line of a 24-well dish and incubate at 37° C. under 5% $CO_2$.

The treatments were added to the cells for 30 min at 37° C. under 5% $CO_2$. The treated cells were transferred to a 1.5 mL microfuge tube and spun down at 1,500 RPM for 5 min. The cells were washed in 1 mL PBS, centrifuged again, and the supernatant aspirated. The treatment reagents included Anti-STAT5 Antibody (rabbit), Cell Signaling No. 94205S; Anti-pSTAT5 Antibody (rabbit), Cell Signaling No. 4322S; and Goat anti-rabbit IgG-HRP, Jackson Immunoresearch No. 111-035-144.

A phosphatase and protease inhibitor cocktail (Thermo No. 78442) were added to mPER buffer at 1:100 dilution. After the cells were pelleted, add 50 µL of mPER buffer was added to each sample and the mixture repeatedly pipetted to homogenize.

The lysates were centrifuged at 14,000 RPM for 5 min at 25° C. The supernatants were transferred to clean tubes and stored frozen at −80° C.

The antibodies, treatment and working stock prep for each of the samples is provided in Table 20.

TABLE 20

STAT5 activation samples in TF-1β and TF-1 cells.

| # | Cell line | Treatment | Vol (µL) | Working stock prep |
|---|-----------|-----------|----------|--------------------|
| 1 | TF-1β | A 10 µM | 100 | 100 µM (1:100 of 10 mM stock in SM) |
| 2 | TF-1β | B 10 µM | 100 | 100 µM (1:100 of 10 mM stock in SM) |
| 3 | TF-1β | C 10 µM | 100 | 100 µM (1:100 of 10 mM stock in SM) |
| 4 | TF-1β | rhIL-2 1 ng/mL | 10 | 100 ng/mL (1:1000 of 100 µg/mL stock in SM) |
| 5 | TF-1β | Starvation Medium[1] (SM) | 100 | N/A |
| 6 | TF-1 | A 10 µM | 100 | 100 µM (1:100 of 10 mM stock in SM) |
| 7 | TF-1 | B 10 µM | 100 | 100 µM (1:100 of 10 mM stock in SM) |
| 8 | TF-1 | C 10 µM | 100 | 100 µM (1:100 of 10 mM stock in SM) |
| 9 | TF-1 | rhIL-2 1 ng/mL | 10 | 100 ng/mL (1:1000 of 100 µg/mL stock in SM) |
| 10 | TF-1 | Starvation Medium[1] (SM) | 100 | N/A |

[1]Starvation medium: RPMI 1640, 2.5 g/L glucose (4.5 g/L total), 5% FBS, 2 mM L-glutamine, 1 mM NaPyr, and 10 mM HEPES (no GM-CSF supplement).

Finally, it should be noted that there are alternative ways of implementing the embodiments disclosed herein. Accordingly, the present embodiments are to be considered as illustrative and not restrictive, and the claims are not to be limited to the details given herein but may be modified within the scope and equivalents thereof.

SEQUENCE LISTING (9432 sequences)

SEQ ID NO: 1-57 - skipped (57 entries)

SEQ ID NO: 58 - protein, 14 aa, Artificial Sequence
  Description of Artificial Sequence: Synthetic peptide
YDCRIAQVGELCDL

SEQ ID NO: 59-82 - skipped (24 entries)

SEQ ID NO: 83 - protein, 14 aa, Artificial Sequence
  Description of Artificial Sequence: Synthetic peptide
CCYQAMVGDLCDFC

SEQ ID NO: 84-141 - skipped (58 entries)

SEQ ID NO: 142 - protein, 8 aa, Artificial Sequence
  Description of Artificial Sequence: Synthetic peptide
EDALLGDF

SEQ ID NO: 143-168 - skipped (26 entries)

SEQ ID NO: 169 - protein, 14 aa, Artificial Sequence
  Description of Artificial Sequence: Synthetic peptide
NMCLVGDYWPSCQI

SEQ ID NO: 170 - protein, 14 aa, Artificial Sequence
  Description of Artificial Sequence: Synthetic peptide
QICDVGQWWPDCQV

SEQ ID NO: 171-197 - skipped (27 entries)

SEQ ID NO: 198 - protein, 14 aa, Artificial Sequence
  Description of Artificial Sequence: Synthetic peptide
KVCEMWGGVLLCWN

SEQ ID NO: 199-201 - skipped (3 entries)

SEQ ID NO: 202 - protein, 14 aa, Artificial Sequence
  Description of Artificial Sequence: Synthetic peptide
RTCTEWENVVLCWV

SEQ ID NO: 203-221 - skipped (19 entries)

SEQ ID NO: 222 - protein, 14 aa, Artificial Sequence
  Description of Artificial Sequence: Synthetic peptide
VMCERWQGVELCWL

SEQ ID NO: 223 - skipped

SEQ ID NO: 224 - protein, 12 aa, Artificial Sequence
  Description of Artificial Sequence: Synthetic peptide
DCSMWEGVELCW

SEQ ID NO: 225-235 - skipped (11 entries)

SEQ ID NO: 236 - protein, 14 aa, Artificial Sequence
  Description of Artificial Sequence: Synthetic peptide
MCWLEWGEWVGSCL

SEQ ID NO: 237-247 - skipped (11 entries)

SEQ ID NO: 248 - protein, 12 aa, Artificial Sequence
  Description of Artificial Sequence: Synthetic peptide
DLSDLSTFWLSQ

SEQ ID NO: 249-265 - skipped (17 entries)

SEQ ID NO: 266 - protein, 14 aa, Artificial Sequence
  Description of Artificial Sequence: Synthetic peptide
CPSMLQGPERTWVC

SEQ ID NO: 267-611 - skipped (345 entries)

SEQ ID NO: 612 - protein, 14 aa, Artificial Sequence
  Description of Artificial Sequence: Synthetic peptide
YPCWMAQLGELCDL

SEQ ID NO: 613-662 - skipped (50 entries)

SEQ ID NO: 663 - protein, 14 aa, Artificial Sequence
  Description of Artificial Sequence: Synthetic peptide
YDCRIAQVGELCDL

SEQ ID NO: 664 - protein, 20 aa, Artificial Sequence
  Description of Artificial Sequence: Synthetic peptide
YPCHMAQLGELCDLWSWGDI

SEQ ID NO: 665-670 - skipped (6 entries)

SEQ ID NO: 671 - protein, 20 aa, Artificial Sequence
  Description of Artificial Sequence: Synthetic peptide
VQYKKCWMAQLGDLCELDPS

SEQ ID NO: 672-804 - skipped (133 entries)

SEQ ID NO: 805 - protein, 17 aa, Artificial Sequence
  Description of Artificial Sequence: Synthetic peptide
  MOD_RES (1)..(1): Any amino acid
  MOD_RES (2)..(2): Any amino acid comprising an aromatic side chain
  MOD_RES (3)..(3): Any amino acid comprising a large hydrophobic side chain or an aromatic side chain
  MOD_RES (6)..(6): Any amino acid comprising an aromatic side chain
  MOD_RES (7)..(7): Any amino acid comprising a large hydrophobic side chain
  MOD_RES (9)..(9): Any amino acid comprising a basic side chain or a polar/neutral side chain
  MOD_RES (10)..(10): Any amino acid comprising a large hydrophobic side chain
  MOD_RES (12)..(12): Any amino acid comprising an acidic side chain or a polar/neutral side chain
  MOD_RES (16)..(16): Any amino acid comprising a large hydrophobic side chain
  MOD_RES (17)..(17): Any amino acid comprising an acidic side chain
XXXPCXXAXXGXLCDXX

SEQ ID NO: 806 - protein, 15 aa, Artificial Sequence
  Description of Artificial Sequence: Synthetic peptide
  MOD_RES (1)..(1): Any amino acid comprising an aromatic side chain
  MOD_RES (2)..(2): Any amino acid comprising a large hydrophobic side chain or an aromatic side chain
  MOD_RES (5)..(5): Any amino acid comprising an aromatic side chain
  MOD_RES (6)..(6): Any amino acid comprising a large hydrophobic side chain
  MOD_RES (8)..(8): Any amino acid comprising a basic side chain or a polar/neutral side chain
  MOD_RES (9)..(9): Any amino acid comprising a large hydrophobic side chain
  MOD_RES (11)..(11): Any amino acid comprising an acidic side chain or a polar/neutral side chain
  MOD_RES (15)..(15): Any amino acid comprising a large hydrophobic side chain
XXPCXXAXXGXLCDX

SEQ ID NO: 807 - protein, 14 aa, Artificial Sequence
  Description of Artificial Sequence: Synthetic peptide
  MOD_RES (1)..(1): Any amino acid comprising a large hydrophobic side chain or an aromatic side chain
  MOD_RES (4)..(4): Any amino acid comprising an aromatic side chain
  MOD_RES (5)..(5): Any amino acid comprising a large hydrophobic side chain
  MOD_RES (7)..(7): Any amino acid comprising a basic side chain or a polar/neutral side chain
  MOD_RES (8)..(8): Any amino acid comprising a large hydrophobic side chain
  MOD_RES (10)..(10): Any amino acid comprising an acidic side chain or a polar/neutral side chain
  MOD_RES (14)..(14): Any amino acid comprising a large hydrophobic side chain
XPCXXAXXGXLCDX

SEQ ID NO: 808 - protein, 12 aa, Artificial Sequence
  Description of Artificial Sequence: Synthetic peptide
  MOD_RES (3)..(3): Any amino acid comprising an aromatic side chain
  MOD_RES (4)..(4): Any amino acid comprising a large hydrophobic side chain
  MOD_RES (6)..(6): Any amino acid comprising a basic side chain or a polar/neutral side chain
  MOD_RES (7)..(7): Any amino acid comprising a large hydrophobic side chain
  MOD_RES (9)..(9): Any amino acid comprising an acidic side chain or a polar/neutral side chain
PCXXAXXGXLCD

SEQ ID NO: 809 - protein, 10 aa, Artificial Sequence
  Description of Artificial Sequence: Synthetic peptide
  MOD_RES (2)..(2): Any amino acid comprising an aromatic side chain
  MOD_RES (3)..(3): Any amino acid comprising a large hydrophobic side chain
  MOD_RES (5)..(5): Any amino acid comprising a basic side chain or a polar/neutral side chain
  MOD_RES (6)..(6): Any amino acid comprising a large hydrophobic side chain
  MOD_RES (8)..(8): Any amino acid comprising an acidic side chain or a polar/neutral side chain
CXXAXXGXLC

SEQ ID NO: 810 - protein, 20 aa, Artificial Sequence
  Description of Artificial Sequence: Synthetic peptide
QPCWLAQVGDLCDLLWPGPL

SEQ ID NO: 811 - protein, 16 aa, Artificial Sequence
  Description of Artificial Sequence: Synthetic peptide
WLPCWIARLGDLCDLE

SEQ ID NO: 812 - protein, 16 aa, Artificial Sequence
  Description of Artificial Sequence: Synthetic peptide
WYPCWMALLGELCDQE

SEQ ID NO: 813 - protein, 16 aa, Artificial Sequence
  Description of Artificial Sequence: Synthetic peptide
WYPCYRARLGELCDLD

SEQ ID NO: 814 - protein, 22 aa, Artificial Sequence
  Description of Artificial Sequence: Synthetic peptide
WQREWRWFPCWMAKLGDMCDLD

SEQ ID NO: 815 - protein, 22 aa, Artificial Sequence
  Description of Artificial Sequence: Synthetic peptide
QDEAVEWFPCWMARLGELCDLE

SEQ ID NO: 816 - protein, 16 aa, Artificial Sequence
  Description of Artificial Sequence: Synthetic peptide
YYPCWMARLGELCDLD

SEQ ID NO: 817 - protein, 22 aa, Artificial Sequence
  Description of Artificial Sequence: Synthetic peptide
SVVVNNWLPCWMAQLGELCDLD

SEQ ID NO: 818 - protein, 16 aa, Artificial Sequence
  Description of Artificial Sequence: Synthetic peptide
WYPCWLAQLGDLCDLD

SEQ ID NO: 819 - protein, 22 aa, Artificial Sequence
  Description of Artificial Sequence: Synthetic peptide
VMSPTRWLPCWIAKLGELCDLE

SEQ ID NO: 820 - protein, 16 aa, Artificial Sequence
  Description of Artificial Sequence: Synthetic peptide
WFPCWMAQLGQLCDLE

SEQ ID NO: 821 - protein, 22 aa, Artificial Sequence
  Description of Artificial Sequence: Synthetic peptide
WRPCWRAYLGELCDLEAMPRAT

SEQ ID NO: 822 - protein, 22 aa, Artificial Sequence
  Description of Artificial Sequence: Synthetic peptide
IRSCSPCWSADVGELCDLECEW

SEQ ID NO: 823 - protein, 22 aa, Artificial Sequence
  Description of Artificial Sequence: Synthetic peptide
SGHWYPCWMARLGELCDMEERA

SEQ ID NO: 824 - protein, 22 aa, Artificial Sequence
  Description of Artificial Sequence: Synthetic peptide
WYPCWMAQLGELCDLQTMGYSH

SEQ ID NO: 825 - protein, 22 aa, Artificial Sequence
  Description of Artificial Sequence: Synthetic peptide
AGDWLPCWMAELGELCDLEGPT

SEQ ID NO: 826 - protein, 22 aa, Artificial Sequence
  Description of Artificial Sequence: Synthetic peptide
WLPCWIASLGELCDLDTGKRQG

SEQ ID NO: 827 - protein, 22 aa, Artificial Sequence
  Description of Artificial Sequence: Synthetic peptide
WLPCWMAHLGQLCDLDLPGKSM

SEQ ID NO: 828 - protein, 22 aa, Artificial Sequence
  Description of Artificial Sequence: Synthetic peptide
EGVFFPCWIARLGELCDLDHGL

SEQ ID NO: 829 - protein, 22 aa, Artificial Sequence
  Description of Artificial Sequence: Synthetic peptide
TGRWKPCWMAGLHELCDLEGFR

SEQ ID NO: 830 - protein, 22 aa, Artificial Sequence
  Description of Artificial Sequence: Synthetic peptide
RKHFYPCWMAQLGELCDLEGMP

SEQ ID NO: 831 - protein, 22 aa, Artificial Sequence
  Description of Artificial Sequence: Synthetic peptide
DIGYYPCWMAQVGDLCDLDDEK

SEQ ID NO: 832 - protein, 22 aa, Artificial Sequence
  Description of Artificial Sequence: Synthetic peptide
DSDWWPCWMAQLGELCDLEDAR

SEQ ID NO: 833 - protein, 22 aa, Artificial Sequence
  Description of Artificial Sequence: Synthetic peptide
GERWKPCWIAQLGELCDLDFNW

SEQ ID NO: 834 - protein, 22 aa, Artificial Sequence
  Description of Artificial Sequence: Synthetic peptide
WWPCWMAQLGEMCDLEYPYVPG

SEQ ID NO: 835 - protein, 22 aa, Artificial Sequence
  Description of Artificial Sequence: Synthetic peptide
QTKLEGWYPCWMAQLGELCDLD

SEQ ID NO: 836 - protein, 22 aa, Artificial Sequence
  Description of Artificial Sequence: Synthetic peptide
WGRKEQWLPCWKAQLGELCDLE

SEQ ID NO: 837 - protein, 22 aa, Artificial Sequence
  Description of Artificial Sequence: Synthetic peptide
VPRANAWHPCWMAQLGELCDLE

SEQ ID NO: 838 - protein, 22 aa, Artificial Sequence
  Description of Artificial Sequence: Synthetic peptide
GRQQKGWYPCWLAQLGELCDME

SEQ ID NO: 839 - protein, 22 aa, Artificial Sequence
  Description of Artificial Sequence: Synthetic peptide
WLNRHLFNPCWMARLGELCDLE

SEQ ID NO: 840 - protein, 22 aa, Artificial Sequence
  Description of Artificial Sequence: Synthetic peptide
AQVRREWYPCWMAQLGELCDLT

SEQ ID NO: 841 - protein, 22 aa, Artificial Sequence
  Description of Artificial Sequence: Synthetic peptide
ETEQMSWYPCWVAQLWELCDLD

SEQ ID NO: 842 - protein, 21 aa, Artificial Sequence
  Description of Artificial Sequence: Synthetic peptide
WLPCWLAKLGELCDLEWLPCW

SEQ ID NO: 843 - protein, 22 aa, Artificial Sequence
  Description of Artificial Sequence: Synthetic peptide
ERRPDTWFPCWRALVGELCDLE

SEQ ID NO: 844 - protein, 22 aa, Artificial Sequence
  Description of Artificial Sequence: Synthetic peptide
WGRNRSWYPCWMAQLGELCDLE

SEQ ID NO: 845 - protein, 22 aa, Artificial Sequence
  Description of Artificial Sequence: Synthetic peptide
QDRRSPWYPCWMAKLGELCDLA

SEQ ID NO: 846 - protein, 24 aa, Artificial Sequence
  Description of Artificial Sequence: Synthetic peptide
TRRWYPCYLAKLGELCDLFEGGTR

SEQ ID NO: 847 - protein, 24 aa, Artificial Sequence
  Description of Artificial Sequence: Synthetic peptide
SEQWWPCWIARLGELCDLDRELSE

SEQ ID NO: 848 - protein, 25 aa, Artificial Sequence
  Description of Artificial Sequence: Synthetic peptide
WYPCWVAQLGEICDLEMTGPDSWYP

SEQ ID NO: 849 - protein, 22 aa, Artificial Sequence
  Description of Artificial Sequence: Synthetic peptide
QDGWLPCWMAQLGELCDLEYKR

SEQ ID NO: 850 - protein, 22 aa, Artificial Sequence
  Description of Artificial Sequence: Synthetic peptide
NRRWYPCWMAQLGELCDLDSRP

SEQ ID NO: 851 - protein, 22 aa, Artificial Sequence
  Description of Artificial Sequence: Synthetic peptide
FYPCWMAHLGELCDLDGDTDSM

SEQ ID NO: 852 - protein, 22 aa, Artificial Sequence
  Description of Artificial Sequence: Synthetic peptide
KSNFFPCWIAQLGQLCDLEPET

SEQ ID NO: 853 - protein, 22 aa, Artificial Sequence
  Description of Artificial Sequence: Synthetic peptide
FYPCWMANLGELCDLDFLRELN

SEQ ID NO: 854 - protein, 22 aa, Artificial Sequence
  Description of Artificial Sequence: Synthetic peptide
HASWLPCWLAQLGELCDLEPNP

SEQ ID NO: 855 - protein, 22 aa, Artificial Sequence
  Description of Artificial Sequence: Synthetic peptide
NGAWYPCWMAQVGELCDLEERW

SEQ ID NO: 856 - protein, 22 aa, Artificial Sequence
  Description of Artificial Sequence: Synthetic peptide
WRRWYPCWVAQVGELCDLEIEA

SEQ ID NO: 857 - protein, 22 aa, Artificial Sequence
  Description of Artificial Sequence: Synthetic peptide
RQAWYPCWMAQLGELCDLEAEL

SEQ ID NO: 858 - protein, 22 aa, Artificial Sequence
  Description of Artificial Sequence: Synthetic peptide
RQRWYPCWMARLGELCDLDEPT

SEQ ID NO: 859 - protein, 22 aa, Artificial Sequence
  Description of Artificial Sequence: Synthetic peptide
NNSREGWFPCWLAKLGDLCDLD

SEQ ID NO: 860 - protein, 16 aa, Artificial Sequence
  Description of Artificial Sequence: Synthetic peptide
YYPCWMAQLGELCDLE

SEQ ID NO: 861 - protein, 16 aa, Artificial Sequence
  Description of Artificial Sequence: Synthetic peptide
WYPCWLAQLGELCDLD

SEQ ID NO: 862 - protein, 22 aa, Artificial Sequence
  Description of Artificial Sequence: Synthetic peptide
SWHAETWYPCWLAQVGELCDLD

SEQ ID NO: 863 - protein, 22 aa, Artificial Sequence
  Description of Artificial Sequence: Synthetic peptide
KMHKAVWLPCWMAQVGELCDLE

SEQ ID NO: 864 - protein, 22 aa, Artificial Sequence
  Description of Artificial Sequence: Synthetic peptide
DVLGDRWYPCWIAKLGELCDLD

SEQ ID NO: 865 - protein, 16 aa, Artificial Sequence
  Description of Artificial Sequence: Synthetic peptide
WYPCWMAQLGELCDLD

SEQ ID NO: 866 - protein, 22 aa, Artificial Sequence
  Description of Artificial Sequence: Synthetic peptide
KLQSWRWYPCWMAQLGELCDLD

SEQ ID NO: 867 - protein, 22 aa, Artificial Sequence
  Description of Artificial Sequence: Synthetic peptide
NEPEGGFYPCWLAQLGELCDLH

SEQ ID NO: 868 - protein, 16 aa, Artificial Sequence
  Description of Artificial Sequence: Synthetic peptide
WYPCWMARLGELCDLE

SEQ ID NO: 869 - protein, 22 aa, Artificial Sequence
  Description of Artificial Sequence: Synthetic peptide
FYPCWTALLGELCDLEPGPPAM

SEQ ID NO: 870 - protein, 22 aa, Artificial Sequence
  Description of Artificial Sequence: Synthetic peptide
WGTTWRWYPCWMAQLGELCDLE

SEQ ID NO: 871 - protein, 22 aa, Artificial Sequence
  Description of Artificial Sequence: Synthetic peptide
AKGWDTWKPCWLANLGELCDLE

SEQ ID NO: 872 - protein, 22 aa, Artificial Sequence
  Description of Artificial Sequence: Synthetic peptide
RDESAGYYPCWIAQLGELCDLE

SEQ ID NO: 873 - protein, 16 aa, Artificial Sequence
  Description of Artificial Sequence: Synthetic peptide
WYPCWIAKLGELCDLE

SEQ ID NO: 874 - protein, 16 aa, Artificial Sequence
  Description of Artificial Sequence: Synthetic peptide
WYPCWIAQLGELCDLD

SEQ ID NO: 875 - protein, 16 aa, Artificial Sequence
  Description of Artificial Sequence: Synthetic peptide
WYPCWLAKLGELCDLD

SEQ ID NO: 876 - protein, 22 aa, Artificial Sequence
  Description of Artificial Sequence: Synthetic peptide
QGPVRLWYPCWMAQLGELCDLD

SEQ ID NO: 877 - protein, 16 aa, Artificial Sequence
  Description of Artificial Sequence: Synthetic peptide
WYPCWMAQPGELCDVD

SEQ ID NO: 878 - protein, 16 aa, Artificial Sequence
  Description of Artificial Sequence: Synthetic peptide
WHPCWIAQLGELCDLE

SEQ ID NO: 879 - protein, 16 aa, Artificial Sequence
  Description of Artificial Sequence: Synthetic peptide
WYPCWIAQLGELCDLE

SEQ ID NO: 880 - protein, 22 aa, Artificial Sequence
  Description of Artificial Sequence: Synthetic peptide
VRPMGVWYPCWIAQLGELCDLV

SEQ ID NO: 881 - protein, 22 aa, Artificial Sequence
  Description of Artificial Sequence: Synthetic peptide
VPRWYPCWIAQLGELCDLDSDD

SEQ ID NO: 882 - protein, 22 aa, Artificial Sequence
  Description of Artificial Sequence: Synthetic peptide
YRGWLPCWRAKLGDLCDLGQPM

SEQ ID NO: 883 - protein, 22 aa, Artificial Sequence
  Description of Artificial Sequence: Synthetic peptide
GEAWYPCWLARLGELCDMDPRV

SEQ ID NO: 884 - protein, 22 aa, Artificial Sequence
  Description of Artificial Sequence: Synthetic peptide
WYPCWMAQLGELCDLDESTRLT

SEQ ID NO: 885 - protein, 22 aa, Artificial Sequence
  Description of Artificial Sequence: Synthetic peptide
IGSWWPCWMAQLGELCDLEPEL

SEQ ID NO: 886 - protein, 22 aa, Artificial Sequence
  Description of Artificial Sequence: Synthetic peptide
GTTWYPCWLAQLGELCDLDVLE

SEQ ID NO: 887 - protein, 22 aa, Artificial Sequence
  Description of Artificial Sequence: Synthetic peptide
WWPCWMAQLGDLCDLEETSGGT

SEQ ID NO: 888 - protein, 22 aa, Artificial Sequence
  Description of Artificial Sequence: Synthetic peptide
WYPCWMAQLGELCDLGPTESNL

SEQ ID NO: 889 - protein, 22 aa, Artificial Sequence
  Description of Artificial Sequence: Synthetic peptide
WYPCWMANLGELCDLEYPSWAQ

SEQ ID NO: 890 - protein, 22 aa, Artificial Sequence
  Description of Artificial Sequence: Synthetic peptide
RGMCYPCWFARLGELCDLECDQ

SEQ ID NO: 891 - protein, 22 aa, Artificial Sequence
  Description of Artificial Sequence: Synthetic peptide
WYPCWMAQLGELCDLDAGARHL

SEQ ID NO: 892 - protein, 22 aa, Artificial Sequence
  Description of Artificial Sequence: Synthetic peptide
KSGWYPCWMAKLGELCDLEAQP

SEQ ID NO: 893 - protein, 22 aa, Artificial Sequence
  Description of Artificial Sequence: Synthetic peptide
GPRFYPCWIAQLGELCDLEDMG

SEQ ID NO: 894 - protein, 22 aa, Artificial Sequence
  Description of Artificial Sequence: Synthetic peptide
RVTWYPCWMAQLGELCDLEESV

SEQ ID NO: 895 - protein, 22 aa, Artificial Sequence
  Description of Artificial Sequence: Synthetic peptide
WLPCWMAQLGDLCDLEQYVPLP

SEQ ID NO: 896 - protein, 22 aa, Artificial Sequence
  Description of Artificial Sequence: Synthetic peptide
YLPCWMAHLGELCDLDSPLKAR

SEQ ID NO: 897 - protein, 22 aa, Artificial Sequence
  Description of Artificial Sequence: Synthetic peptide
WYPCWMAQLGELCDLDDHWPAM

SEQ ID NO: 898 - protein, 22 aa, Artificial Sequence
  Description of Artificial Sequence: Synthetic peptide
WYPCWRAQLGELCDLDPPIAVE

SEQ ID NO: 899 - protein, 22 aa, Artificial Sequence
  Description of Artificial Sequence: Synthetic peptide
WYPCWMANLGELCDLEAERSPV

SEQ ID NO: 900 - protein, 22 aa, Artificial Sequence
  Description of Artificial Sequence: Synthetic peptide
RDQYYPCWMAQLGELCDLDEVF

SEQ ID NO: 901 - protein, 22 aa, Artificial Sequence
  Description of Artificial Sequence: Synthetic peptide
WYPCWMAQLGDLCDLEKPVTER

SEQ ID NO: 902 - protein, 22 aa, Artificial Sequence
  Description of Artificial Sequence: Synthetic peptide
WYPCWIARLGELCDLETSGGFP

SEQ ID NO: 903 - protein, 21 aa, Artificial Sequence
  Description of Artificial Sequence: Synthetic peptide
SGHCYPCWLAGLGELCDLNCG

SEQ ID NO: 904-910 - skipped (7 entries)

SEQ ID NO: 911 - protein, 18 aa, Artificial Sequence
  Description of Artificial Sequence: Synthetic peptide
GGYDCRIAQVGELCDLGG

SEQ ID NO: 912 - protein, 23 aa, Artificial Sequence
  Description of Artificial Sequence: Synthetic peptide
GVQYKKCWMAQLGDLCELDPSGG

SEQ ID NO: 913 - protein, 20 aa, Artificial Sequence
  Description of Artificial Sequence: Synthetic peptide
GGYPCWMAQLGELCDLGGRR

SEQ ID NO: 914 - skipped

SEQ ID NO: 915 - protein, 22 aa, Artificial Sequence
  Description of Artificial Sequence: Synthetic peptide
GGWYPCWMAQLGELCDLDGGRR

SEQ ID NO: 916 - protein, 26 aa, Artificial Sequence
  Description of Artificial Sequence: Synthetic peptide
GGYPCHMAQLGELCDLWSWGDIGGRR

SEQ ID NO: 917 - protein, 24 aa, Artificial Sequence
  Description of Artificial Sequence: Synthetic peptide
FYPCWTALLGELCDLEPGPPAMGG

SEQ ID NO: 918 - protein, 24 aa, Artificial Sequence
  Description of Artificial Sequence: Synthetic peptide
WRRWYPCWVAQVGELCDLEIEAGG

SEQ ID NO: 919 - protein, 24 aa, Artificial Sequence
  Description of Artificial Sequence: Synthetic peptide
RQRWYPCWMARLGELCDLDEPTGG

SEQ ID NO: 920 - protein, 24 aa, Artificial Sequence
  Description of Artificial Sequence: Synthetic peptide
WYPCWMAQLGDLCDLEKPVTERGG

SEQ ID NO: 921 - protein, 26 aa, Artificial Sequence
  Description of Artificial Sequence: Synthetic peptide
GGFYPCWTALLGELCDLEPGPPAMGG

SEQ ID NO: 922 - protein, 26 aa, Artificial Sequence
  Description of Artificial Sequence: Synthetic peptide
GGWGTTWRWYPCWMAQLGELCDLEGG

SEQ ID NO: 923 - protein, 25 aa, Artificial Sequence
  Description of Artificial Sequence: Synthetic peptide
GGDVLGDRWYPCWIAKGELCDLDGG

SEQ ID NO: 924 - protein, 19 aa, Artificial Sequence
  Description of Artificial Sequence: Synthetic peptide
GGWPCWIAQLGELCDLDGG

SEQ ID NO: 925 - protein, 20 aa, Artificial Sequence
  Description of Artificial Sequence: Synthetic peptide
GGWYPCWLAKLGELCDLDGG

SEQ ID NO: 926 - protein, 26 aa, Artificial Sequence
  Description of Artificial Sequence: Synthetic peptide
GGWYPCWMAQLGDLCDLEKPVTERGG

SEQ ID NO: 927 - protein, 26 aa, Artificial Sequence
  Description of Artificial Sequence: Synthetic peptide
GGWRRWYPCWVAQVGELCDLEIEAGG

SEQ ID NO: 928 - protein, 26 aa, Artificial Sequence
  Description of Artificial Sequence: Synthetic peptide
GGRQRWYPCWMARLGELCDLDEPTGG

SEQ ID NO: 929 - protein, 24 aa, Artificial Sequence
  Description of Artificial Sequence: Synthetic peptide
GGVQYKKCWMAQLGDLCELDPSGG

SEQ ID NO: 930 - protein, 24 aa, Artificial Sequence
  Description of Artificial Sequence: Synthetic peptide
GGYPCHMAQLGELCDLWSWGDIGG

SEQ ID NO: 931-943 - skipped (13 entries)

SEQ ID NO: 944 - protein, 20 aa, Artificial Sequence
  Description of Artificial Sequence: Synthetic peptide
  MOD_RES (1)..(1): Any amino acid comprising a basic side chain
  MOD_RES (2)..(2): Any amino acid comprising a hydroxyl-containing side chain
  MOD_RES (3)..(3): Any amino acid comprising an acidic side chain or a large hydrophobic side chain
  MOD_RES (4)..(4): Any amino acid comprising a large hydrophobic side chain
  MOD_RES (5)..(5): Any amino acid comprising an acidic side chain or a large hydrophobic side chain
  MOD_RES (7)..(7): Any amino acid comprising an acidic side chain or a polar/neutral side chain
  MOD_RES (8)..(8): Any amino acid comprising an acidic side chain
  MOD_RES (9)..(9): Any amino acid comprising a large hydrophobic side chain or an aromatic side chain
  MOD_RES (10)..(10): Any amino acid comprising an acidic side chain or a polar/neutral side chain
  MOD_RES (17)..(17): Any amino acid comprising a large hydrophobic side chain
  MOD_RES (19)..(19): Any amino acid
  MOD_RES (20)..(20): Any amino acid comprising an acidic side chain
XXXXXCXXXXGVELCWXEXX

SEQ ID NO: 945 - protein, 18 aa, Artificial Sequence
  Description of Artificial Sequence: Synthetic peptide
  MOD_RES (1)..(1): Any amino acid comprising a hydroxyl-containing side chain
  MOD_RES (2)..(2): Any amino acid comprising an acidic side chain or a large hydrophobic side chain
  MOD_RES (3)..(3): Any amino acid comprising a large hydrophobic side chain
  MOD_RES (4)..(4): Any amino acid comprising an acidic side chain or a large hydrophobic side chain
  MOD_RES (6)..(6): Any amino acid comprising an acidic side chain or a polar/neutral side chain
  MOD_RES (7)..(7): Any amino acid comprising an acidic side chain
  MOD_RES (8)..(8): Any amino acid comprising a large hydrophobic side chain or an aromatic side chain
  MOD_RES (9)..(9): Any amino acid comprising an acidic side chain or a polar/neutral side chain
  MOD_RES (16)..(16): Any amino acid comprising a large hydrophobic side chain
  MOD_RES (18)..(18): Any amino acid
XXXXCXXXXGVELCWXEX

SEQ ID NO: 946 - protein, 16 aa, Artificial Sequence
  Description of Artificial Sequence: Synthetic peptide
  MOD_RES (1)..(1): Any amino acid comprising an acidic side chain or a large hydrophobic side chain
  MOD_RES (2)..(2): Any amino acid comprising a large hydrophobic side chain
  MOD_RES (3)..(3): Any amino acid comprising an acidic side chain or a large hydrophobic side chain
  MOD_RES (5)..(5): Any amino acid comprising an acidic side chain or a polar/neutral side chain
  MOD_RES (6)..(6): Any amino acid comprising an acidic side chain
  MOD_RES (7)..(7): Any amino acid comprising a large hydrophobic side chain or an aromatic side chain
  MOD_RES (8)..(8): Any amino acid comprising an acidic side chain or a polar/neutral side chain
  MOD_RES (15)..(15): Any amino acid comprising a large hydrophobic side chain
XXXCXXXXGVELCWXE

SEQ ID NO: 947 - protein, 14 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising an acidic side chain or a large hydrophobic side chain
  MOD_RES (4)..(4): Any amino acid comprising an acidic side chain or a polar/neutral side chain
  MOD_RES (5)..(5): Any amino acid comprising an acidic side chain
  MOD_RES (6)..(6): Any amino acid comprising a large hydrophobic side chain or an aromatic side chain
  MOD_RES (7)..(7): Any amino acid comprising an acidic side chain or a polar/neutral side chain
  MOD_RES (14)..(14): Any amino acid comprising a large hydrophobic side chain
XXCXXXXGVELCWX

SEQ ID NO: 948 - protein, 12 aa, Artificial Sequence
  Description of Artificial Sequence: Synthetic peptide
  MOD_RES (1)..(1): Any amino acid comprising an acidic side chain or a large hydrophobic side chain
  MOD_RES (3)..(3): Any amino acid comprising an acidic side chain or a polar/neutral side chain
  MOD_RES (4)..(4): Any amino acid comprising an acidic side chain
  MOD_RES (5)..(5): Any amino acid comprising a large hydrophobic side chain or an aromatic side chain
  MOD_RES (6)..(6): Any amino acid comprising an acidic side chain or a polar/neutral side chain
XCXXXXGVELCW

SEQ ID NO: 949 - protein, 10 aa, Artificial Sequence
  Description of Artificial Sequence: Synthetic peptide
  MOD_RES (2)..(2): Any amino acid comprising an acidic side chain or a polar/neutral side chain
  MOD_RES (3)..(3): Any amino acid comprising an acidic side chain
  MOD_RES (4)..(4): Any amino acid comprising a large hydrophobic side chain or an aromatic side chain
  MOD_RES (5)..(5): Any amino acid comprising an acidic side chain or a polar/neutral side chain
CXXXXGVELC

SEQ ID NO: 950 - protein, 14 aa, Artificial Sequence
  Description of Artificial Sequence: Synthetic peptide
IECDTSYGVYICWQ

SEQ ID NO: 951 - protein, 14 aa, Artificial Sequence
  Description of Artificial Sequence: Synthetic peptide
IECEEWRGVELCWQ

SEQ ID NO: 952 - protein, 20 aa, Artificial Sequence
  Description of Artificial Sequence: Synthetic peptide
PEGREVVVCRDWYGVELCWQ

SEQ ID NO: 953 - protein, 20 aa, Artificial Sequence
  Description of Artificial Sequence: Synthetic peptide
IWGRTVVECQDWEGVELCWQ

SEQ ID NO: 954 - protein, 20 aa, Artificial Sequence
  Description of Artificial Sequence: Synthetic peptide
LALRKEVVCQEYYGVELCWI

SEQ ID NO: 955 - protein, 20 aa, Artificial Sequence
  Description of Artificial Sequence: Synthetic peptide
HEAREVVVCQDWYGVELCWQ

SEQ ID NO: 956 - protein, 20 aa, Artificial Sequence
  Description of Artificial Sequence: Synthetic peptide
MVNREVVVCEDWYGVELCWQ

SEQ ID NO: 957 - protein, 20 aa, Artificial Sequence
  Description of Artificial Sequence: Synthetic peptide
TANQTVVECQVWGGVELCWQ

SEQ ID NO: 958 - protein, 14 aa, Artificial Sequence
  Description of Artificial Sequence: Synthetic peptide
VECQEWGGVELCWC

SEQ ID NO: 959 - protein, 15 aa, Artificial Sequence
  Description of Artificial Sequence: Synthetic peptide
DVECVDWGGVELCWH

SEQ ID NO: 960 - protein, 14 aa, Artificial Sequence
  Description of Artificial Sequence: Synthetic peptide
IVCEEWRGVELCWL

SEQ ID NO: 961 - protein, 20 aa, Artificial Sequence
  Description of Artificial Sequence: Synthetic peptide
DFERSYVVCQDWDGVELCWI

SEQ ID NO: 962 - protein, 20 aa, Artificial Sequence
  Description of Artificial Sequence: Synthetic peptide
AHSRQEVVCEEWYGVELCWI

SEQ ID NO: 963 - protein, 20 aa, Artificial Sequence
  Description of Artificial Sequence: Synthetic peptide
SAPERWVECEDWQGVELCWV

SEQ ID NO: 964 - protein, 20 aa, Artificial Sequence
  Description of Artificial Sequence: Synthetic peptide
YSRELYVQCEDWEGVELCWI

SEQ ID NO: 965 - protein, 14 aa, Artificial Sequence
  Description of Artificial Sequence: Synthetic peptide
VVCQDWEGVELCWQ

SEQ ID NO: 966 - protein, 15 aa, Artificial Sequence
  Description of Artificial Sequence: Synthetic peptide
DVVCQNWEGVDLCWH

SEQ ID NO: 967 - protein, 20 aa, Artificial Sequence
  Description of Artificial Sequence: Synthetic peptide
SAGRQEVVCQDWNGVELCWI

SEQ ID NO: 968 - protein, 20 aa, Artificial Sequence
  Description of Artificial Sequence: Synthetic peptide
GQGREVVVCHDWYGVELCWQ

SEQ ID NO: 969 - protein, 20 aa, Artificial Sequence
  Description of Artificial Sequence: Synthetic peptide
DWRRSVVECQDWYGVELCWQ

SEQ ID NO: 970 - protein, 15 aa, Artificial Sequence
  Description of Artificial Sequence: Synthetic peptide
DVVCQNWDGVDLCWH

SEQ ID NO: 971 - protein, 20 aa, Artificial Sequence
  Description of Artificial Sequence: Synthetic peptide
TLGRTVVECQDWGGVELCWQ

SEQ ID NO: 972 - protein, 20 aa, Artificial Sequence
  Description of Artificial Sequence: Synthetic peptide
RLLNSVVECLDWEGVELCWQ

SEQ ID NO: 973 - protein, 14 aa, Artificial Sequence
  Description of Artificial Sequence: Synthetic peptide
IVCEDWRGVELCWI

SEQ ID NO: 974 - protein, 14 aa, Artificial Sequence
  Description of Artificial Sequence: Synthetic peptide
VVCQEWEGVELCWC

SEQ ID NO: 975 - protein, 20 aa, Artificial Sequence
  Description of Artificial Sequence: Synthetic peptide
GDRPKEVVCEDWKGVELCWI

SEQ ID NO: 976 - protein, 20 aa, Artificial Sequence
  Description of Artificial Sequence: Synthetic peptide
ERPRSFIECQEWEGVELCWL

SEQ ID NO: 977 - protein, 20 aa, Artificial Sequence
  Description of Artificial Sequence: Synthetic peptide
EGSTTTIECEEWAGVELCWL

SEQ ID NO: 978 - protein, 20 aa, Artificial Sequence
  Description of Artificial Sequence: Synthetic peptide
ANQNTVVECQDWHGVELCWQ

SEQ ID NO: 979 - protein, 20 aa, Artificial Sequence
  Description of Artificial Sequence: Synthetic peptide
RSDDEVVVCQEWEGVELCWQ

SEQ ID NO: 980 - protein, 14 aa, Artificial Sequence
  Description of Artificial Sequence: Synthetic peptide
IECEEWAGVELCWL

SEQ ID NO: 981 - protein, 20 aa, Artificial Sequence
  Description of Artificial Sequence: Synthetic peptide
TWNMSELECQDWNGVEICWH

SEQ ID NO: 982 - protein, 20 aa, Artificial Sequence
  Description of Artificial Sequence: Synthetic peptide
GNDDSYIVCEEWKGVELCWI

SEQ ID NO: 983 - protein, 20 aa, Artificial Sequence
  Description of Artificial Sequence: Synthetic peptide
FAHHGVVECQEWYGVELCWQ

SEQ ID NO: 984 - protein, 20 aa, Artificial Sequence
  Description of Artificial Sequence: Synthetic peptide
LNRSVWIECEEYEGVELCWL

SEQ ID NO: 985 - protein, 20 aa, Artificial Sequence
  Description of Artificial Sequence: Synthetic peptide
WSKKAEVVCEEWGGVEFCWI

SEQ ID NO: 986 - protein, 20 aa, Artificial Sequence
  Description of Artificial Sequence: Synthetic peptide
RSNQTVVECQDWEGVELCWQ

SEQ ID NO: 987 - protein, 20 aa, Artificial Sequence
  Description of Artificial Sequence: Synthetic peptide
VVCQEWEGVELCWYAGECMQ

SEQ ID NO: 988 - protein, 20 aa, Artificial Sequence
  Description of Artificial Sequence: Synthetic peptide
ILCQEFEGVELCWLEESLAE

SEQ ID NO: 989 - protein, 20 aa, Artificial Sequence
  Description of Artificial Sequence: Synthetic peptide
KSQVECQDWEGVELCWVVSE

SEQ ID NO: 990 - protein, 20 aa, Artificial Sequence
  Description of Artificial Sequence: Synthetic peptide
KITVECQDWDGVELCWPTWI

SEQ ID NO: 991 - protein, 20 aa, Artificial Sequence
  Description of Artificial Sequence: Synthetic peptide
RPQIECQEWQGVELCWTREE

SEQ ID NO: 992 - protein, 20 aa, Artificial Sequence
  Description of Artificial Sequence: Synthetic peptide
VSCQEWDGVELCWVDGDLAA

SEQ ID NO: 993 - protein, 20 aa, Artificial Sequence
  Description of Artificial Sequence: Synthetic peptide
IMCQEWDGVELCWLERDKAN

SEQ ID NO: 994 - protein, 20 aa, Artificial Sequence
  Description of Artificial Sequence: Synthetic peptide
GLEIACEDWYGVELCWLRRA

SEQ ID NO: 995 - protein, 24 aa, Artificial Sequence
  Description of Artificial Sequence: Synthetic peptide
GYGVLCQEWQGVELCWPVQREAGV

SEQ ID NO: 996 - protein, 20 aa, Artificial Sequence
  Description of Artificial Sequence: Synthetic peptide
PYGVVCQDWAGVELCWVENR

SEQ ID NO: 997 - protein, 20 aa, Artificial Sequence
  Description of Artificial Sequence: Synthetic peptide
KLTVECQDWDGVELCWVGVE

SEQ ID NO: 998 - protein, 20 aa, Artificial Sequence
  Description of Artificial Sequence: Synthetic peptide
INCQTWNGVELCWVDEGLYQ

SEQ ID NO: 999 - protein, 20 aa, Artificial Sequence
  Description of Artificial Sequence: Synthetic peptide
VVCQEWEGVELCWVEPPLLP

SEQ ID NO: 1000 - protein, 20 aa, Artificial Sequence
  Description of Artificial Sequence: Synthetic peptide
RVQVECEDWNGVELCWPVRV

SEQ ID NO: 1001 - protein, 20 aa, Artificial Sequence
  Description of Artificial Sequence: Synthetic peptide
DRQVVCEEWDGVELCWIEES

SEQ ID NO: 1002 - protein, 20 aa, Artificial Sequence
  Description of Artificial Sequence: Synthetic peptide
KTTVACQDWGGVELCWVERV

SEQ ID NO: 1003 - protein, 20 aa, Artificial Sequence
  Description of Artificial Sequence: Synthetic peptide
RPEVVCQEWEGVELCWISPL

SEQ ID NO: 1004 - protein, 20 aa, Artificial Sequence
  Description of Artificial Sequence: Synthetic peptide
RLGVECQEWEGVDLCWISAF

SEQ ID NO: 1005 - protein, 20 aa, Artificial Sequence
  Description of Artificial Sequence: Synthetic peptide
KPVVVCEEWQGVELCWLEIQ

SEQ ID NO: 1006 - protein, 20 aa, Artificial Sequence
  Description of Artificial Sequence: Synthetic peptide
VVCEVFQGVELCWCENEEFT

SEQ ID NO: 1007 - protein, 20 aa, Artificial Sequence
  Description of Artificial Sequence: Synthetic peptide
TDEVSCQEWEGVELCWIERQ

SEQ ID NO: 1008 - protein, 20 aa, Artificial Sequence
  Description of Artificial Sequence: Synthetic peptide
PVEVRCQEWEGVELCWVVGI

SEQ ID NO: 1009 - protein, 20 aa, Artificial Sequence
  Description of Artificial Sequence: Synthetic peptide
GPEVVCEEFNRVELCWVEYN

SEQ ID NO: 1010 - protein, 20 aa, Artificial Sequence
  Description of Artificial Sequence: Synthetic peptide
KYIVECQEWGGVELCWPEMV

SEQ ID NO: 1011 - protein, 20 aa, Artificial Sequence
  Description of Artificial Sequence: Synthetic peptide
VTCQEYEGVELCWTVGCAYS

SEQ ID NO: 1012 - protein, 21 aa, Artificial Sequence
  Description of Artificial Sequence: Synthetic peptide
VVCQEWEGVELCWQTGPGAHA

SEQ ID NO: 1013 - protein, 20 aa, Artificial Sequence
  Description of Artificial Sequence: Synthetic peptide
IVCEEYNGVELCWVETSVKP

SEQ ID NO: 1014 - protein, 20 aa, Artificial Sequence
  Description of Artificial Sequence: Synthetic peptide
EQQVVCQEWNGVELCWIEAG

SEQ ID NO: 1015 - protein, 20 aa, Artificial Sequence
  Description of Artificial Sequence: Synthetic peptide
QLGVECQNWRGVELCWVSEI

SEQ ID NO: 1016 - protein, 20 aa, Artificial Sequence
  Description of Artificial Sequence: Synthetic peptide
TAEVVCQEWDGVELCWIEVL

SEQ ID NO: 1017 - protein, 20 aa, Artificial Sequence
  Description of Artificial Sequence: Synthetic peptide
SPSIVCEEWAGVELCWVDYS

SEQ ID NO: 1018 - protein, 20 aa, Artificial Sequence
  Description of Artificial Sequence: Synthetic peptide
AVCQDWYGVELCWCMQDILD

SEQ ID NO: 1019 - protein, 20 aa, Artificial Sequence
  Description of Artificial Sequence: Synthetic peptide
VECEEWGGVELCWLADEVMW

SEQ ID NO: 1020 - protein, 20 aa, Artificial Sequence
  Description of Artificial Sequence: Synthetic peptide
HSTVICQDWDGVELCWIEND

SEQ ID NO: 1021 - protein, 20 aa, Artificial Sequence
  Description of Artificial Sequence: Synthetic peptide
KKIVVCQDWGGVELCWTEDD

SEQ ID NO: 1022 - protein, 20 aa, Artificial Sequence
  Description of Artificial Sequence: Synthetic peptide
SVEVVCEEWHGVELCWPVFI

SEQ ID NO: 1023 - protein, 20 aa, Artificial Sequence
  Description of Artificial Sequence: Synthetic peptide
RWAVSCQDWQGIELCWPEWD

SEQ ID NO: 1024 - protein, 20 aa, Artificial Sequence
  Description of Artificial Sequence: Synthetic peptide
RTGVECQDWHGVELCWPVWE

SEQ ID NO: 1025 - protein, 20 aa, Artificial Sequence
  Description of Artificial Sequence: Synthetic peptide
GYGVVCEDFRGVELCWLERK

SEQ ID NO: 1026 - protein, 17 aa, Artificial Sequence
  Description of Artificial Sequence: Synthetic peptide
RTEVECEDWEGVELCWL

SEQ ID NO: 1027 - protein, 19 aa, Artificial Sequence
  Description of Artificial Sequence: Synthetic peptide
ILCEEWQGVELCWLEGGGS

SEQ ID NO: 1028 - protein, 16 aa, Artificial Sequence
  Description of Artificial Sequence: Synthetic peptide
VGIECEEWAGVELCWL

SEQ ID NO: 1029-1031 - skipped (3 entries)

SEQ ID NO: 1032 - protein, 15 aa, Artificial Sequence
  Description of Artificial Sequence: Synthetic peptide
SLLKCYNASTCASVF

SEQ ID NO: 1033 - skipped

SEQ ID NO: 1034 - protein, 12 aa, Artificial Sequence
  Description of Artificial Sequence: Synthetic peptide
CGMAIGDLCMWT

SEQ ID NO: 1035-1041 - skipped (7 entries)

SEQ ID NO: 1042 - protein, 12 aa, Artificial Sequence
  Description of Artificial Sequence: Synthetic peptide
RWGDVGDLLMPL

SEQ ID NO: 1043 - skipped

SEQ ID NO: 1044 - protein, 14 aa, Artificial Sequence
  Description of Artificial Sequence: Synthetic peptide
RSCYYKRPRLWCSE

SEQ ID NO: 1045-1050 - skipped (6 entries)

SEQ ID NO: 1051 - protein, 16 aa, Artificial Sequence
  Description of Artificial Sequence: Synthetic peptide
DCSMWEGVELCWGGRR

SEQ ID NO: 1052 - protein, 20 aa, Artificial Sequence
  Description of Artificial Sequence: Synthetic peptide
GGVVCQDWEGVELCWQGGRR

SEQ ID NO: 1053 - protein, 18 aa, Artificial Sequence
  Description of Artificial Sequence: Synthetic peptide
GGVMCERWQGVELCWLGG

SEQ ID NO: 1054 - protein, 24 aa, Artificial Sequence
  Description of Artificial Sequence: Synthetic peptide
GGRTGVECQDWHGVELCWPVWEGG

SEQ ID NO: 1055 - protein, 20 aa, Artificial Sequence
  Description of Artificial Sequence: Synthetic peptide
GGVGIECEEWAGVELCWLGG

SEQ ID NO: 1056 - protein, 24 aa, Artificial Sequence
  Description of Artificial Sequence: Synthetic peptide
GGTWNMSELECQDWNGVEICWHGG

SEQ ID NO: 1057 - protein, 21 aa, Artificial Sequence
  Description of Artificial Sequence: Synthetic peptide
GGRTEVECEDWEGVELCWLGG

SEQ ID NO: 1058 - protein, 24 aa, Artificial Sequence
  Description of Artificial Sequence: Synthetic peptide
GGWSKKAEVVCEEWGGVEFCWIGG

SEQ ID NO: 1059 - protein, 20 aa, Artificial Sequence
  Description of Artificial Sequence: Synthetic peptide
WSKKAEVVCEEWGGVEFCWI

SEQ ID NO: 1060 - protein, 20 aa, Artificial Sequence
  Description of Artificial Sequence: Synthetic peptide
YSRELYVQCEDWEGVELCWI

SEQ ID NO: 1061-1208 - skipped (148 entries)

SEQ ID NO: 1209 - protein, 18 aa, Artificial Sequence
  Description of Artificial Sequence: Synthetic peptide
GWHPCWIAQLGELCDLEG

SEQ ID NO: 1210 - protein, 20 aa, Artificial Sequence
  Description of Artificial Sequence: Synthetic peptide
GGWHPCWIAQLGELCDLEGG

SEQ ID NO: 1211 - protein, 22 aa, Artificial Sequence
  Description of Artificial Sequence: Synthetic peptide
GGGWHPCWIAQLGELCDLEGGG

SEQ ID NO: 1212 - protein, 284 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGVVCQDWEGVELCWQGG

SEQ ID NO: 1213 - protein, 286 aa, Artificial Sequence
  Description of Artificial Sequence: Synthetic polypeptide
AEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGARTGGGGSGGGGSGGWYPCWMAQLGELCDLDGGGGSGGVVCQDWEGVELCWQGG

SEQ ID NO: 1214 - protein, 278 aa, Artificial Sequence
  Description of Artificial Sequence: Synthetic polypeptide
APPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLGSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGARTGGGGSGGGGSGGWYPCWMAQLGELCDLDGGGGSGGVVCQDWEGVELCWQGG

SEQ ID NO: 1215 - protein, 283 aa, Artificial Sequence
  Description of Artificial Sequence: Synthetic polypeptide
GGWYPCWMAQLGELCDLDGGGGSGGVVCQDWEGVELCWQGGGGSGGGGSGGGGSRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1216 - protein, 292 aa, Artificial Sequence
  Description of Artificial Sequence: Synthetic polypeptide
GITVAEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGWYPCWMAQLGELCDLDGGGGSGGVVCQDWEGVELCWQGG

SEQ ID NO: 1217 - protein, 231 aa, Artificial Sequence
  Description of Artificial Sequence: Synthetic polypeptide
EPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 1218 - protein, 218 aa, Artificial Sequence
  Description of Artificial Sequence: Synthetic polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1219 - protein, 498 aa, Artificial Sequence
  Description of Artificial Sequence: Synthetic polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGAGGGGSGGGGSGGWYPCWMAQLGELCDLDGGGGSGGVVCQDWEGVELCWQGG

SEQ ID NO: 1220 - protein, 214 aa, Artificial Sequence
  Description of Artificial Sequence: Synthetic polypeptide
DIQMTQSPSSLSASVGDSITITCRASLSINTFLNWYQQKPGKAPNLLIYAASSLHGGVPSRFSGSGSGTDFTLTIRTLQPEDFATYYCQQSSNTPFTFGPGTVVDFRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1221 - protein, 495 aa, Artificial Sequence
  Description of Artificial Sequence: Synthetic polypeptide
EVQLLESGGVLVQPGGSLRLSCAASGFTFSNFGMTWVRQAPGKGLEWVSGISGGGRDTYFADSVKGRFTISRDNSKNTLYLQMNSLKGEDTAVYYCVKWGNIYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGAGGGGSGGGGSGGWYPCWMAQLGELCDLDGGGGSGGVVCQDWEGVELCWQGG

SEQ ID NO: 1222 - protein, 213 aa, Artificial Sequence
  Description of Artificial Sequence: Synthetic polypeptide
DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1223 - protein, 497 aa, Artificial Sequence
  Description of Artificial Sequence: Synthetic polypeptide
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAGGGGSGGGGSGGWYPCWMAQLGELCDLDGGGGSGGVVCQDWEGVELCWQGG

SEQ ID NO: 1224 - protein, 288 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAGSGSGSGSGSGSGSGSGSGSGGWYPCWMAQLGELCDLDGGGGSGGVVCQDWEGVELCWQGG

SEQ ID NO: 1225 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGAGSGSGSGSGSGSGSGSGSGSGGWYPCWMAQLGELCDLDGGGGSGGVVCQDWEGVELCWQGG

SEQ ID NO: 1226 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWMAQLGELCDLDGGGGSGGVVCQDWEGVELCWQGG

SEQ ID NO: 1227 - protein, 279 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGWYPCWMAQLGELCDLDGGGGSGGVVCQDWEGVELCWQGG

SEQ ID NO: 1228 - protein, 289 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGGGSGGWYPCWMAQLGELCDLDGGGGSGGVVCQDWEGVELCWQGG

SEQ ID NO: 1229 - protein, 294 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGGGSGGGGSGGWYPCWMAQLGELCDLDGGGGSGGVVCQDWEGVELCWQGG

SEQ ID NO: 1230 - protein, 276 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGWYPCWMAQLGELCDLDGGGGSGGVVCQDWEGVELCWQGG

SEQ ID NO: 1231 - protein, 279 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGGGGWYPCWMAQLGELCDLDGGGGSGGVVCQDWEGVELCWQGG

SEQ ID NO: 1232 - protein, 294 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGWYPCWMAQLGELCDLDGGGGSGGVVCQDWEGVELCWQGG

SEQ ID NO: 1233 - protein, 284 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAGGWYPCWMAQLGELCDLDGGGGSGGVVCQDWEGVELCWQGG

SEQ ID NO: 1234 - protein, 294 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAPAPAPAPAPAGGWYPCWMAQLGELCDLDGGGGSGGVVCQDWEGVELCWQGG

SEQ ID NO: 1235 - protein, 288 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAPAPAGGWYPCWMAQLGELCDLDGGGGSGGVVCQDWEGVELCWQGG

SEQ ID NO: 1236 - protein, 288 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGVQYKKCWMAQLGDLCELDPSGGGGSGGVVCQDWEGVELCWQGG

SEQ ID NO: 1237 - protein, 288 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGYPCHMAQLGELCDLWSWGDIGGGGSGGVVCQDWEGVELCWQGG

SEQ ID NO: 1238 - protein, 282 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGYPCWMAQLGELCDLGGGGSGGVVCQDWEGVELCWQGG

SEQ ID NO: 1239 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGWSKKAEVVCEEWGGVEFCWIGG

SEQ ID NO: 1240 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGRTGVECQDWHGVELCWPVWEGG

SEQ ID NO: 1241 - protein, 286 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGVGIECEEWAGVELCWLGG

SEQ ID NO: 1242 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGTWNMSELECQDWNGVEICWHGG

SEQ ID NO: 1243 - protein, 287 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGRTEVECEDWEGVELCWLGG

SEQ ID NO: 1244 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGFYPCWTALLGELCDLEPGPPAMGGGGSGGVVCQDWEGVELCWQGG

SEQ ID NO: 1245 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWGTTWRWYPCWMAQLGELCDLEGGGGSGGVVCQDWEGVELCWQGG

SEQ ID NO: 1246 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGDVLGDRWYPCWIAKLGELCDLDGGGGSGGVVCQDWEGVELCWQGG

SEQ ID NO: 1247 - protein, 284 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWIAQLGELCDLDGGGGSGGVVCQDWEGVELCWQGG

SEQ ID NO: 1248 - protein, 284 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWLAKLGELCDLDGGGGSGGVVCQDWEGVELCWQGG

SEQ ID NO: 1249 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGDLCDLEKPVTERGGGGSGGVVCQDWEGVELCWQGG

SEQ ID NO: 1250 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWRRWYPCWVAQVGELCDLEIEAGGGGSGGVVCQDWEGVELCWQGG

SEQ ID NO: 1251 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGRQRWYPCWMARLGELCDLDEPTGGGGSGGVVCQDWEGVELCWQGG

SEQ ID NO: 1252 - protein, 648 aa, Artificial Sequence
  Description of Artificial Sequence: Synthetic polypeptide
GGHHHHHHGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLRTGGGGSGGGGSGGWYPCWMAQLGELCDLDGGGGSGGVVCQDWEGVELCWQGG

SEQ ID NO: 1253-1262 - skipped (10 entries)

SEQ ID NO: 1263 - protein, 41 aa, Artificial Sequence
  Description of Artificial Sequence: Synthetic polypeptide
GGWYPCWMAQLGELCDLDGGGGSGGVVCQDWEGVELCWQGG

SEQ ID NO: 1264 - protein, 37 aa, Artificial Sequence
  Description of Artificial Sequence: Synthetic polypeptide
WYPCWMAQLGELCDLDGGGGSGGVVCQDWEGVELCWQ

SEQ ID NO: 1265 - protein, 54 aa, Artificial Sequence
  Description of Artificial Sequence: Synthetic polypeptide
  MOD_RES (19)..(38): Any amino acid
  MISC_FEATURE (19)..(38): This region may encompass 1-20 residues
WYPCWMAQLGELCDLDGGXXXXXXXXXXXXXXXXXXXXGGVVCQDWEGVELCWQ

SEQ ID NO: 1266 - protein, 60 aa, Artificial Sequence
  Description of Artificial Sequence: Synthetic polypeptide
  MOD_RES (17)..(46): Any amino acid
  MISC_FEATURE (17)..(46): This region may encompass 1-30 residues
WYPCWMAQLGELCDLDXXXXXXXXXXXXXXXXXXXXXXXXXXXXXXVVCQDWEGVELCWQ

SEQ ID NO: 1267 - protein, 39 aa, Artificial Sequence
  Description of Artificial Sequence: Synthetic polypeptide
GWYPCWMAQLGELCDLDGGGGSGGVVCQDWEGVELCWQG

SEQ ID NO: 1268 - protein, 40 aa, Artificial Sequence
  Description of Artificial Sequence: Synthetic polypeptide
GGWYPCWMAQLGELCDLDGGGGSGGVVCQDWEGVELCWQG

SEQ ID NO: 1269 - protein, 40 aa, Artificial Sequence
  Description of Artificial Sequence: Synthetic polypeptide
GWYPCWMAQLGELCDLDGGGGSGGVVCQDWEGVELCWQGG

SEQ ID NO: 1270 - protein, 60 aa, Artificial Sequence
  Description of Artificial Sequence: Synthetic polypeptide
  MOD_RES (1)..(5): Any amino acid
  MISC_EFATURE (1)..(5): This region may encompass 1-5 residues or be absent in its entirety
  MOD_RES (22)..(41): Any amino acid
  MISC_FEATURE (22)..(41): This region may encompass 1-20 residues
  MOD_RES (56)..(60): Any amino acid
  MISC_EFATURE (56)..(60): This region may encompass 1-5 residues or be absent in its entirety
XXXXXWYPCWMAQLGELCDLDXXXXXXXXXXXXXXXXXXXXVVCQDWEGVELCWQXXXXX

SEQ ID NO: 1271-1600 - skipped (330 entries)

SEQ ID NO: 1601 - protein, 16 aa, Artificial Sequence
  Description of Artificial Sequence: Synthetic peptide
GGDCSMWEGVELCWGG

SEQ ID NO: 1602 - protein, 18 aa, Artificial Sequence
  Description of Artificial Sequence: Synthetic peptide
GGVMCERWQGVELCWLGG

SEQ ID NO: 1603 - protein, 20 aa, Artificial Sequence
  Description of Artificial Sequence: Synthetic peptide
GGVGIECEEWAGVELCWLGG

SEQ ID NO: 1604 - protein, 24 aa, Artificial Sequence
  Description of Artificial Sequence: Synthetic peptide
GGTWNMSELECQDWNGVEICWHGG

SEQ ID NO: 1605 - protein, 21 aa, Artificial Sequence
  Description of Artificial Sequence: Synthetic peptide
GGRTEVECEDWEGVELCWLGG

SEQ ID NO: 1606 - protein, 24 aa, Artificial Sequence
  Description of Artificial Sequence: Synthetic peptide
GGRTGVECQDWHGVELCWPVWEGG

SEQ ID NO: 1607 - protein, 18 aa, Artificial Sequence
  Description of Artificial Sequence: Synthetic peptide
  MOD_RES (12)..(12): Abu
GGVVCQDWEGVXLCWQGG

SEQ ID NO: 1608 - protein, 18 aa, Artificial Sequence
  Description of Artificial Sequence: Synthetic peptide
  MOD_RES (12)..(12): Alb
GGVVCQDWEGVXLCWQGG

SEQ ID NO: 1609 - protein, 19 aa, Artificial Sequence
  Description of Artificial Sequence: Synthetic peptide
GGVVCQDWEGVDALCWQGG

SEQ ID NO: 1610 - protein, 18 aa, Artificial Sequence
  Description of Artificial Sequence: Synthetic peptide
GGVVCQDWEGVSLCWQGG

SEQ ID NO: 1611 - protein, 18 aa, Artificial Sequence
  Description of Artificial Sequence: Synthetic peptide
GGVVCQDWEGVGLCWQGG

SEQ ID NO: 1612 - protein, 19 aa, Artificial Sequence
  Description of Artificial Sequence: Synthetic peptide
GGVVCQDWEGVELCWQPPA

SEQ ID NO: 1613 - protein, 20 aa, Artificial Sequence
  Description of Artificial Sequence: Synthetic peptide
GGVVCQDWEGVELCWQGPPA

SEQ ID NO: 1614-2574 - skipped (961 entries)

SEQ ID NO: 2575 - protein, 16 aa, Artificial Sequence
  Description of Artificial Sequence: Synthetic peptide
  MOD_RES (1)..(1): E, F, G, I, L, R, S, W, or Y
  MOD_RES (2)..(2): F, H, K, L, N, Q, S, T, V, W, or Y
  MOD_RES (3)..(3): E, G, L, P, or S
  MOD_RES (5)..(5): E, F, G, H, Q, R, S, W, or Y
  MOD_RES (6)..(6): E, I, K, L, M, N, R, S, T, or V
  MOD_RES (7)..(7): A, D, G, or Y
  MOD_RES (8)..(8): A, C, D, E, G, H, K, L, N, Q, R, S, or T
  MOD_RES (9)..(9): D, F, L, M, P, R, or V
  MOD_RES (10)..(10): G, R W, or Y
  MOD_RES (11)..(11): A, D, E, Q, W, or Y
  MOD_RES (12)..(12): I, L, Q, V, or Y
  MOD_RES (14)..(14): D, E, G, H, V, or Y
  MOD_RES (15)..(15): D, F, H, I, K, L, M, or V or
  MOD_RES (16)..(16): A, D, E, G, H, K, L, N, Q, V, or W
XXXCXXXXXXXXCXXX

SEQ ID NO: 2576 - protein, 14 aa, Artificial Sequence
  Description of Artificial Sequence: Synthetic peptide
  MOD_RES (1)..(1): F, H, K, L, N, Q, S, T, V, W, or Y
  MOD_RES (2)..(2): E, G, L, P, or S
  MOD_RES (4)..(4): E, F, G, H, Q, R, S, W, or Y
  MOD_RES (5)..(5): E, I, K, L, M, N, R, S, T, or V
  MOD_RES (6)..(6): A, D, G, or Y
  MOD_RES (7)..(7): A, C, D, E, G, H, K, L, N, Q, R, S, or T
  MOD_RES (8)..(8): D, F, L, M, P, R, or V
  MOD_RES (9)..(9): G, R W, or Y
  MOD_RES (10)..(10): A, D, E, Q, W, or Y
  MOD_RES (11)..(11): I, L, Q, V, or Y
  MOD_RES (13)..(13): D, E, G, H, V, or Y
  MOD_RES (14)..(14): D, F, H, I, K, L, M, or V or
XXCXXXXXXXXCXX

SEQ ID NO: 2577 - protein, 12 aa, Artificial Sequence
  Description of Artificial Sequence: Synthetic peptide
  MOD_RES (1)..(1): E, G, L, P, or S
  MOD_RES (3)..(3): E, F, G, H, Q, R, S, W, or Y
  MOD_RES (4)..(4): E, I, K, L, M, N, R, S, T, or V
  MOD_RES (5)..(5): A, D, G, or Y
  MOD_RES (6)..(6): A, C, D, E, G, H, K, L, N, Q, R, S, or T
  MOD_RES (7)..(7): D, F, L, M, P, R, or V
  MOD_RES (8)..(8): G, R W, or Y
  MOD_RES (9)..(9): A, D, E, Q, W, or Y
  MOD_RES (10)..(10): I, L, Q, V, or Y
  MOD_RES (12)..(12): D, E, G, H, V, or Y
XCXXXXXXXXCX

SEQ ID NO: 2578 - protein, 10 aa, Artificial Sequence
  Description of Artificial Sequence: Synthetic peptide
  MOD_RES (2)..(2): E, F, G, H, Q, R, S, W, or Y
  MOD_RES (3)..(3): E, I, K, L, M, N, R, S, T, or V
  MOD_RES (4)..(4): A, D, G, or Y
  MOD_RES (5)..(5): A, C, D, E, G, H, K, L, N, Q, R, S, or T
  MOD_RES (6)..(6): D, F, L, M, P, R, or V
  MOD_RES (7)..(7): G, R W, or Y
  MOD_RES (8)..(8): A, D, E, Q, W, or Y
  MOD_RES (9)..(9): I, L, Q, V, or Y
CXXXXXXXXC

SEQ ID NO: 2579 - protein, 8 aa, Artificial Sequence
  Description of Artificial Sequence: Synthetic peptide
  MOD_RES (1)..(1): E, F, G, H, Q, R, S, W, or Y
  MOD_RES (2)..(2): E, I, K, L, M, N, R, S, T, or V
  MOD_RES (3)..(3): A, D, G, or Y
  MOD_RES (4)..(4): A, C, D, E, G, H, K, L, N, Q, R, S, or T
  MOD_RES (5)..(5): D, F, L, M, P, R, or V
  MOD_RES (6)..(6): G, R W, or Y
  MOD_RES (7)..(7): A, D, E, Q, W, or Y
  MOD_RES (8)..(8): I, L, Q, V, or Y
XXXXXXXX

SEQ ID NO: 2580 - protein, 21 aa, Artificial Sequence
  Description of Artificial Sequence: Synthetic peptide
VRAWYPCWIARLGELCDLEVD

SEQ ID NO: 2581 - protein, 16 aa, Artificial Sequence
  Description of Artificial Sequence: Synthetic peptide
WFPCWMAQLGEVCDLD

SEQ ID NO: 2582 - protein, 16 aa, Artificial Sequence
  Description of Artificial Sequence: Synthetic peptide
WYPCHMAKLRELCDLD

SEQ ID NO: 2583 - protein, 16 aa, Artificial Sequence
  Description of Artificial Sequence: Synthetic peptide
SLPCWMAQLGDLCELH

SEQ ID NO: 2584 - protein, 16 aa, Artificial Sequence
  Description of Artificial Sequence: Synthetic peptide
SNPCWMAQLWELCDLE

SEQ ID NO: 2585 - protein, 16 aa, Artificial Sequence
  Description of Artificial Sequence: Synthetic peptide
YKPCWIAQLGELCELE

SEQ ID NO: 2586 - protein, 16 aa, Artificial Sequence
  Description of Artificial Sequence: Synthetic peptide
WQPCWMAQLGELCDLE

SEQ ID NO: 2587 - protein, 16 aa, Artificial Sequence
  Description of Artificial Sequence: Synthetic peptide
WKPCWLAQLGDLCEME

SEQ ID NO: 2588 - protein, 16 aa, Artificial Sequence
  Description of Artificial Sequence: Synthetic peptide
WLPCWMAKLGDLCELE

SEQ ID NO: 2589 - protein, 16 aa, Artificial Sequence
  Description of Artificial Sequence: Synthetic peptide
WLPCWMAQLGELCVME

SEQ ID NO: 2590 - protein, 16 aa, Artificial Sequence
  Description of Artificial Sequence: Synthetic peptide
LHPCWMAQLGELCDLE

SEQ ID NO: 2591 - protein, 16 aa, Artificial Sequence
  Description of Artificial Sequence: Synthetic peptide
SLPCWMAQLGELCDLV

SEQ ID NO: 2592 - protein, 16 aa, Artificial Sequence
  Description of Artificial Sequence: Synthetic peptide
WKPCWMAGLGELCELD

SEQ ID NO: 2593 - protein, 16 aa, Artificial Sequence
  Description of Artificial Sequence: Synthetic peptide
WWPCSSAELGEICDFD

SEQ ID NO: 2594 - protein, 16 aa, Artificial Sequence
  Description of Artificial Sequence: Synthetic peptide
WQPCWRAKLGELCDLE

SEQ ID NO: 2595 - protein, 16 aa, Artificial Sequence
  Description of Artificial Sequence: Synthetic peptide
WSPCWIATLGELCDLD

SEQ ID NO: 2596 - protein, 16 aa, Artificial Sequence
  Description of Artificial Sequence: Synthetic peptide
WNPCWIAQLGDLCDMV

SEQ ID NO: 2597 - protein, 16 aa, Artificial Sequence
  Description of Artificial Sequence: Synthetic peptide
WLPCWLAHLGDICDLQ

SEQ ID NO: 2598 - protein, 22 aa, Artificial Sequence
  Description of Artificial Sequence: Synthetic peptide
WLSPPSYLPCWMAQLGELCDLV

SEQ ID NO: 2599 - protein, 22 aa, Artificial Sequence
  Description of Artificial Sequence: Synthetic peptide
WDVHAIRNPCWLAKLGDLCDLD

SEQ ID NO: 2600 - protein, 22 aa, Artificial Sequence
  Description of Artificial Sequence: Synthetic peptide
GAGVLHRWPCWMAKLGDLCDLD

SEQ ID NO: 2601 - protein, 22 aa, Artificial Sequence
  Description of Artificial Sequence: Synthetic peptide
DTGRDGWKPCWMALLGELCELE

SEQ ID NO: 2602 - protein, 22 aa, Artificial Sequence
  Description of Artificial Sequence: Synthetic peptide
EQGMLGYFPCWKALLGDVCDLD

SEQ ID NO: 2603 - protein, 22 aa, Artificial Sequence
  Description of Artificial Sequence: Synthetic peptide
WRVTASLQPCWMAQLGELCDLN

SEQ ID NO: 2604 - protein, 22 aa, Artificial Sequence
  Description of Artificial Sequence: Synthetic peptide
GQVVETSLPCWEAQLGELCVLD

SEQ ID NO: 2605 - protein, 22 aa, Artificial Sequence
  Description of Artificial Sequence: Synthetic peptide
TVGQFEWYPCSTAQLGELCDLD

SEQ ID NO: 2606 - protein, 22 aa, Artificial Sequence
  Description of Artificial Sequence: Synthetic peptide
ALVGGTFYPCYVAHLGELCDIE

SEQ ID NO: 2607 - protein, 22 aa, Artificial Sequence
  Description of Artificial Sequence: Synthetic peptide
IDRADGWKPCWIAQVGELCVLE

SEQ ID NO: 2608 - protein, 22 aa, Artificial Sequence
  Description of Artificial Sequence: Synthetic peptide
YRRERVEFPCWLAQLGELCDKE

SEQ ID NO: 2609 - protein, 22 aa, Artificial Sequence
  Description of Artificial Sequence: Synthetic peptide
AVSHGNWLPCYIAQLGELCDLD

SEQ ID NO: 2610 - protein, 22 aa, Artificial Sequence
  Description of Artificial Sequence: Synthetic peptide
IPKGESWFPCWMAAMGELCDLE

SEQ ID NO: 2611 - protein, 22 aa, Artificial Sequence
  Description of Artificial Sequence: Synthetic peptide
WYPCWIAQLGEVCDLEKQTGSV

SEQ ID NO: 2612 - protein, 22 aa, Artificial Sequence
  Description of Artificial Sequence: Synthetic peptide
WYPCWMAHLGDVCDLESFGQTE

SEQ ID NO: 2613 - protein, 22 aa, Artificial Sequence
  Description of Artificial Sequence: Synthetic peptide
YKPCQMAQLGELCDLDVDNKAE

SEQ ID NO: 2614 - protein, 22 aa, Artificial Sequence
  Description of Artificial Sequence: Synthetic peptide
FKPCWIANLGELCDMDDERSSE

SEQ ID NO: 2615 - protein, 22 aa, Artificial Sequence
  Description of Artificial Sequence: Synthetic peptide
WKPCWMARLGELCDIEDTKVNA

SEQ ID NO: 2616 - protein, 22 aa, Artificial Sequence
  Description of Artificial Sequence: Synthetic peptide
SLPCWIARLGELCDLDGYDGEE

SEQ ID NO: 2617 - protein, 22 aa, Artificial Sequence
  Description of Artificial Sequence: Synthetic peptide
FYPCWKARLGELCELEELRGYY

SEQ ID NO: 2618 - protein, 22 aa, Artificial Sequence
  Description of Artificial Sequence: Synthetic peptide
WKPCWIADLGELCDLAPAWHEY

SEQ ID NO: 2619 - protein, 22 aa, Artificial Sequence
  Description of Artificial Sequence: Synthetic peptide
RLPCWRAQLGDLCELDWGLDMG

SEQ ID NO: 2620 - protein, 22 aa, Artificial Sequence
  Description of Artificial Sequence: Synthetic peptide
SKPCWMAQLGELCDLDVWNLQM

SEQ ID NO: 2621 - protein, 22 aa, Artificial Sequence
  Description of Artificial Sequence: Synthetic peptide
GYPCWLAQLGDYCDLDAGAPSW

SEQ ID NO: 2622 - protein, 22 aa, Artificial Sequence
  Description of Artificial Sequence: Synthetic peptide
SWPCWMAQLGDLCDLDGSAGAS

SEQ ID NO: 2623 - protein, 22 aa, Artificial Sequence
  Description of Artificial Sequence: Synthetic peptide
WKPCWLAQLGELCDLERPSTTS

SEQ ID NO: 2624 - protein, 22 aa, Artificial Sequence
  Description of Artificial Sequence: Synthetic peptide
WYSCGKAQLGELCDLDVESQPG

SEQ ID NO: 2625 - protein, 22 aa, Artificial Sequence
  Description of Artificial Sequence: Synthetic peptide
YVPCYMARLGELCELEANRPGQ

SEQ ID NO: 2626 - protein, 22 aa, Artificial Sequence
  Description of Artificial Sequence: Synthetic peptide
SKPCWLAQLGDLCDFDWTAADH

SEQ ID NO: 2627 - protein, 22 aa, Artificial Sequence
  Description of Artificial Sequence: Synthetic peptide
WFPCWMAQLGDLCELEPDSVPA

SEQ ID NO: 2628 - protein, 22 aa, Artificial Sequence
  Description of Artificial Sequence: Synthetic peptide
WTPCWIAHLGDLCDLEPQDDTD

SEQ ID NO: 2629 - protein, 22 aa, Artificial Sequence
  Description of Artificial Sequence: Synthetic peptide
WKPCFIASLGELCDLDQGSVEV

SEQ ID NO: 2630 - protein, 22 aa, Artificial Sequence
  Description of Artificial Sequence: Synthetic peptide
WKPCWMAALGELCDLERSVGKV

SEQ ID NO: 2631 - protein, 22 aa, Artificial Sequence
  Description of Artificial Sequence: Synthetic peptide
WKPCWRAQLGELCDLELGPSER

SEQ ID NO: 2632 - protein, 22 aa, Artificial Sequence
  Description of Artificial Sequence: Synthetic peptide
FFPCWMGQLGDLCDLEVRSMQK

SEQ ID NO: 2633 - protein, 22 aa, Artificial Sequence
  Description of Artificial Sequence: Synthetic peptide
YWPCSMASLGELCDLEWQGRLP

SEQ ID NO: 2634 - protein, 22 aa, Artificial Sequence
  Description of Artificial Sequence: Synthetic peptide
WYPCYMASLGELCDLQSSISPR

SEQ ID NO: 2635 - protein, 22 aa, Artificial Sequence
  Description of Artificial Sequence: Synthetic peptide
WYPCWMAQLGELCDHEWPSYGA

SEQ ID NO: 2636 - protein, 22 aa, Artificial Sequence
  Description of Artificial Sequence: Synthetic peptide
MGSWLPCWMAQLGDLCDVEGGM

SEQ ID NO: 2637 - protein, 22 aa, Artificial Sequence
  Description of Artificial Sequence: Synthetic peptide
QKGFLPCWRAQLGQLCDMESQY

SEQ ID NO: 2638 - protein, 22 aa, Artificial Sequence
  Description of Artificial Sequence: Synthetic peptide
GSGWQPCWMADLGELCDLDNEK

SEQ ID NO: 2639 - protein, 22 aa, Artificial Sequence
  Description of Artificial Sequence: Synthetic peptide
WRRWYPCWMAQLGELCDLDQWT

SEQ ID NO: 2640 - protein, 22 aa, Artificial Sequence
  Description of Artificial Sequence: Synthetic peptide
RRSWYPCRIAQLGELCDLDPRV

SEQ ID NO: 2641 - protein, 22 aa, Artificial Sequence
  Description of Artificial Sequence: Synthetic peptide
AYRIYPCWKAQLGELCDLDNAD

SEQ ID NO: 2642 - protein, 22 aa, Artificial Sequence
  Description of Artificial Sequence: Synthetic peptide
QRNSFPCWLAQLGDLCDLGDWA

SEQ ID NO: 2643 - protein, 22 aa, Artificial Sequence
  Description of Artificial Sequence: Synthetic peptide
QPAWLPCWLAQLGELCDLGTGA

SEQ ID NO: 2644 - protein, 22 aa, Artificial Sequence
  Description of Artificial Sequence: Synthetic peptide
SRFWQPCWMAQLGELCHLDPQM

SEQ ID NO: 2645 - protein, 22 aa, Artificial Sequence
  Description of Artificial Sequence: Synthetic peptide
YLNFNPCWTAQLGELCDLASGE

SEQ ID NO: 2646 - protein, 22 aa, Artificial Sequence
  Description of Artificial Sequence: Synthetic peptide
STGWYPCWIAEFGELCDLVKPH

SEQ ID NO: 2647 - protein, 22 aa, Artificial Sequence
  Description of Artificial Sequence: Synthetic peptide
AHWSQPCWTAQLGELCDLDMGD

SEQ ID NO: 2648 - protein, 22 aa, Artificial Sequence
  Description of Artificial Sequence: Synthetic peptide
HPVRYPCWVAQLGELCDLENGN

SEQ ID NO: 2649 - protein, 22 aa, Artificial Sequence
  Description of Artificial Sequence: Synthetic peptide
QTGSYPCWIAHLGELCDLEGSA

SEQ ID NO: 2650 - protein, 21 aa, Artificial Sequence
  Description of Artificial Sequence: Synthetic peptide
TGWWYPCWMAQLGELCDLQQT

SEQ ID NO: 2651 - protein, 19 aa, Artificial Sequence
  Description of Artificial Sequence: Synthetic peptide
DLWQPCWMARLGELCDLKG

SEQ ID NO: 2652 - protein, 20 aa, Artificial Sequence
  Description of Artificial Sequence: Synthetic peptide
MGTGWQNYCRYAQLGELCLL

SEQ ID NO: 2653 - protein, 16 aa, Artificial Sequence
  Description of Artificial Sequence: Synthetic peptide
WYPCGVAQPGDLCDLE

SEQ ID NO: 2654 - protein, 22 aa, Artificial Sequence
  Description of Artificial Sequence: Synthetic peptide
MLGEWLCEMDQLGYLCYLDHGD

SEQ ID NO: 2655 - protein, 20 aa, Artificial Sequence
  Description of Artificial Sequence: Synthetic peptide
WDGWECGMDHDGWVCEFWGE

SEQ ID NO: 2656-2660 - skipped (5 entries)

SEQ ID NO: 2661 - protein, 19 aa, Artificial Sequence
  Description of Artificial Sequence: Synthetic peptide
  MOD_RES (1)..(1): A, D, E, F, G, H, I, K, L, M, N, P, Q, R, S, T, V, W, or Y
  MOD_RES (2)..(2): C, D, F, G, I, L, M, R, S, V, W, or Y
  MOD_RES (3)..(3): A, D, F, H, K, L, N, P, Q, R, S, T, V, W, or Y
  MOD_RES (4)..(4): A, D, F, L, N, P, Q, S, T, or W
  MOD_RES (6)..(6): D, E, F, G, L, M, Q, R, S, W, or Y
  MOD_RES (7)..(7): A, F, I, K, L, M, N, Q, R, S, V, W, or Y
  MOD_RES (8)..(8): A, D, E, I, S, T, V, or W
  MOD_RES (9)..(9): A, E, F, G, H, K, L, N, P, Q, R, S, V, W, or Y
  MOD_RES (10)..(10): A, E, I, L, M, P, Q V, or W
  MOD_RES (11)..(11): F, G, or V
  MOD_RES (12)..(12): D, E, N, P, Q, S, V, W, or Y
  MOD_RES (13)..(13): D, F, H, I, L, M, Q, S, T, V, or W
  MOD_RES (15)..(15): A, D, E, L, N, Q, S, T, or V
  MOD_RES (16)..(16): A, E, F, I, K, L, M, Q, R S, T V, or W
  MOD_RES (17)..(17): A, D, E, F, G, I, K, L, N, P, Q, R, T, V, W, or Y
  MOD_RES (18)..(18): A, C, D, E, F, G, H, I, L, M, N, P, Q, R, S, T, V, W, or Y
  MOD_RES (19)..(19): A, D, E, F, G, H, I, K, L, M N, P, Q, R, S, T, V, W, or Y
XXXXCXXXXXXXXCXXXXX

SEQ ID NO: 2662 - protein, 16 aa, Artificial Sequence
  Description of Artificial Sequence: Synthetic peptide
  MOD_RES (1)..(1): C, D, F, G, I, L, M, R, S, V, W, or Y
  MOD_RES (2)..(2): A, D, F, H, K, L, N, P, Q, R, S, T, V, W, or Y
  MOD_RES (3)..(3): A, D, F, L, N, P, Q, S, T, or W
  MOD_RES (5)..(5): D, E, F, G, L, M, Q, R, S, W, or Y
  MOD_RES (6)..(6): A, F, I, K, L, M, N, Q, R, S, V, W, or Y
  MOD_RES (7)..(7): A, D, E, I, S, T, V, or W
  MOD_RES (8)..(8): A, E, F, G, H, K, L, N, P, Q, R, S, V, W, or Y
  MOD_RES (9)..(9): A, E, I, L, M, P, Q V, or W
  MOD_RES (10)..(10): F, G, or V
  MOD_RES (11)..(11): D, E, N, P, Q, S, V, W, or Y
  MOD_RES (12)..(12): D, F, H, I, L, M, Q, S, T, V, or W
  MOD_RES (14)..(14): A, D, E, L, N, Q, S, T, or V
  MOD_RES (15)..(15): A, E, F, I, K, L, M, Q, R S, T V, or W
  MOD_RES (16)..(16): A, D, E, F, G, I, K, L, N, P, Q, R, T, V, W, or Y
XXXCXXXXXXXXCXXX

SEQ ID NO: 2663 - protein, 14 aa, Artificial Sequence
  Description of Artificial Sequence: Synthetic peptide
  MOD_RES (1)..(1): A, D, F, H, K, L, N, P, Q, R, S, T, V, W, or Y
  MOD_RES (2)..(2): A, D, F, L, N, P, Q, S, T, or W
  MOD_RES (4)..(4): D, E, F, G, L, M, Q, R, S, W, or Y
  MOD_RES (5)..(5): A, F, I, K, L, M, N, Q, R, S, V, W, or Y
  MOD_RES (6)..(6): A, D, E, I, S, T, V, or W
  MOD_RES (7)..(7): A, E, F, G, H, K, L, N, P, Q, R, S, V, W, or Y
  MOD_RES (8)..(8): A, E, I, L, M, P, Q V, or W
  MOD_RES (9)..(9): F, G, or V
  MOD_RES (10)..(10): D, E, N, P, Q, S, V, W, or Y
  MOD_RES (11)..(11): D, F, H, I, L, M, Q, S, T, V, or W
  MOD_RES (13)..(13): A, D, E, L, N, Q, S, T, or V
  MOD_RES (14)..(14): A, E, F, I, K, L, M, Q, R S, T V, or W
XXCXXXXXXXXCXX

SEQ ID NO: 2664 - protein, 12 aa, Artificial Sequence
  Description of Artificial Sequence: Synthetic peptide
  MOD_RES (1)..(1): A, D, F, L, N, P, Q, S, T, or W
  MOD_RES (3)..(3): D, E, F, G, L, M, Q, R, S, W, or Y
  MOD_RES (4)..(4): A, F, I, K, L, M, N, Q, R, S, V, W, or Y
  MOD_RES (5)..(5): A, D, E, I, S, T, V, or W
  MOD_RES (6)..(6): A, E, F, G, H, K, L, N, P, Q, R, S, V, W, or Y
  MOD_RES (7)..(7): A, E, I, L, M, P, Q V, or W
  MOD_RES (8)..(8): F, G, or V
  MOD_RES (9)..(9): D, E, N, P, Q, S, V, W, or Y
  MOD_RES (10)..(10): D, F, H, I, L, M, Q, S, T, V, or W
  MOD_RES (12)..(12): A, D, E, L, N, Q, S, T, or V
XCXXXXXXXXCX

SEQ ID NO: 2665 - protein, 10 aa, Artificial Sequence
  Description of Artificial Sequence: Synthetic peptide
  MOD_RES (2)..(2): D, E, F, G, L, M, Q, R, S, W, or Y
  MOD_RES (3)..(3): A, F, I, K, L, M, N, Q, R, S, V, W, or Y
  MOD_RES (4)..(4): A, D, E, I, S, T, V, or W
  MOD_RES (5)..(5): A, E, F, G, H, K, L, N, P, Q, R, S, V, W, or Y
  MOD_RES (6)..(6): A, E, I, L, M, P, Q V, or W
  MOD_RES (7)..(7): F, G, or V
  MOD_RES (8)..(8): D, E, N, P, Q, S, V, W, or Y
  MOD_RES (9)..(9): D, F, H, I, L, M, Q, S, T, V, or W
CXXXXXXXXC

SEQ ID NO: 2666 - protein, 8 aa, Artificial Sequence
  Description of Artificial Sequence: Synthetic peptide
  MOD_RES (1)..(1): D, E, F, G, L, M, Q, R, S, W, or Y
  MOD_RES (2)..(2): A, F, I, K, L, M, N, Q, R, S, V, W, or Y
  MOD_RES (3)..(3): A, D, E, I, S, T, V, or W
  MOD_RES (4)..(4): A, E, F, G, H, K, L, N, P, Q, R, S, V, W, or Y
  MOD_RES (5)..(5): A, E, I, L, M, P, Q V, or W
  MOD_RES (6)..(6): F, G, or V
  MOD_RES (7)..(7): D, E, N, P, Q, S, V, W, or Y
  MOD_RES (8)..(8): D, F, H, I, L, M, Q, S, T, V, or W
XXXXXXXX

SEQ ID NO: 2667 - protein, 22 aa, Artificial Sequence
  Description of Artificial Sequence: Synthetic peptide
WYPCWIAQLGELCDLDAKGQRR

SEQ ID NO: 2668 - protein, 22 aa, Artificial Sequence
  Description of Artificial Sequence: Synthetic peptide
TNNFYPCWLAKLGDLCDFDDLN

SEQ ID NO: 2669 - protein, 22 aa, Artificial Sequence
  Description of Artificial Sequence: Synthetic peptide
WYPCWIARVGELCDLEEGPVNR

SEQ ID NO: 2670 - protein, 21 aa, Artificial Sequence
  Description of Artificial Sequence: Synthetic peptide
AVEFYPCWLARIGELCDLVEP

SEQ ID NO: 2671 - protein, 16 aa, Artificial Sequence
  Description of Artificial Sequence: Synthetic peptide
WYPCWIAHLGELCDLE

SEQ ID NO: 2672 - protein, 16 aa, Artificial Sequence
  Description of Artificial Sequence: Synthetic peptide
WYPCWIARVGELCDME

SEQ ID NO: 2673 - protein, 21 aa, Artificial Sequence
  Description of Artificial Sequence: Synthetic peptide
RREWYPCWIAQVGELCDLPLI

SEQ ID NO: 2674 - protein, 22 aa, Artificial Sequence
  Description of Artificial Sequence: Synthetic peptide
RWPWYPCEIARIGELCDLEQAN

SEQ ID NO: 2675 - protein, 22 aa, Artificial Sequence
  Description of Artificial Sequence: Synthetic peptide
FGAFYPCWKAQLGELCDLEPVT

SEQ ID NO: 2676 - protein, 22 aa, Artificial Sequence
  Description of Artificial Sequence: Synthetic peptide
HGRWFPCWMAQVGDLCDLEHSN

SEQ ID NO: 2677 - protein, 22 aa, Artificial Sequence
  Description of Artificial Sequence: Synthetic peptide
WYPCWLAKLGELCDLDRAEALP

SEQ ID NO: 2678 - protein, 20 aa, Artificial Sequence
  Description of Artificial Sequence: Synthetic peptide
VWFPCWFAQLGDLCDLDQDP

SEQ ID NO: 2679 - protein, 22 aa, Artificial Sequence
  Description of Artificial Sequence: Synthetic peptide
ETLGSVWYPCWIASIGELCDLD

SEQ ID NO: 2680 - protein, 22 aa, Artificial Sequence
  Description of Artificial Sequence: Synthetic peptide
WYSCWIAQLGELCDLDDMGDRV

SEQ ID NO: 2681 - protein, 16 aa, Artificial Sequence
  Description of Artificial Sequence: Synthetic peptide
WFPCWLAQLGELCDKE

SEQ ID NO: 2682 - protein, 16 aa, Artificial Sequence
  Description of Artificial Sequence: Synthetic peptide
WYPCWIAQLGELCDLV

SEQ ID NO: 2683 - protein, 22 aa, Artificial Sequence
  Description of Artificial Sequence: Synthetic peptide
SHLWFPCWMAQLGELCDLEGGP

SEQ ID NO: 2684 - protein, 21 aa, Artificial Sequence
  Description of Artificial Sequence: Synthetic peptide
RRWLPCWMAHVGELCDLELGN

SEQ ID NO: 2685 - protein, 21 aa, Artificial Sequence
  Description of Artificial Sequence: Synthetic peptide
YWCWFARVGELCDLDDGGVPS

SEQ ID NO: 2686 - protein, 16 aa, Artificial Sequence
  Description of Artificial Sequence: Synthetic peptide
WYSCWIAQIGELCDLE

SEQ ID NO: 2687 - protein, 22 aa, Artificial Sequence
  Description of Artificial Sequence: Synthetic peptide
MNPVGTFYPCWIAKLGELCDLQ

SEQ ID NO: 2688 - protein, 22 aa, Artificial Sequence
  Description of Artificial Sequence: Synthetic peptide
HGGVIGWYPCWMAKVGELCDLD

SEQ ID NO: 2689 - protein, 22 aa, Artificial Sequence
  Description of Artificial Sequence: Synthetic peptide
WYPCSIALLGELCDLESVHEKS

SEQ ID NO: 2690 - protein, 22 aa, Artificial Sequence
  Description of Artificial Sequence: Synthetic peptide
EQRNRQWWPCWLARLGDLCDLD

SEQ ID NO: 2691 - protein, 16 aa, Artificial Sequence
  Description of Artificial Sequence: Synthetic peptide
WYPCWLAQLGELCDLD

SEQ ID NO: 2692 - protein, 16 aa, Artificial Sequence
  Description of Artificial Sequence: Synthetic peptide
WLPCWMAHLGDLCDLE

SEQ ID NO: 2693 - protein, 22 aa, Artificial Sequence
  Description of Artificial Sequence: Synthetic peptide
RPSWAPCWLAQVGELCDLDHPE

SEQ ID NO: 2694 - protein, 22 aa, Artificial Sequence
  Description of Artificial Sequence: Synthetic peptide
ESKEPAFWPCWMAQLGDLCDLE

SEQ ID NO: 2695 - protein, 22 aa, Artificial Sequence
  Description of Artificial Sequence: Synthetic peptide
RSLRESWFPCWMAKLGDLCDLE

SEQ ID NO: 2696 - protein, 16 aa, Artificial Sequence
  Description of Artificial Sequence: Synthetic peptide
WHPCWLARVGDLCDLD

SEQ ID NO: 2697 - protein, 22 aa, Artificial Sequence
  Description of Artificial Sequence: Synthetic peptide
SRSAGEYYPCWLAQLGELCDLA

SEQ ID NO: 2698 - protein, 22 aa, Artificial Sequence
  Description of Artificial Sequence: Synthetic peptide
RQVPKQWYPCWMAALGELCDLE

SEQ ID NO: 2699 - protein, 16 aa, Artificial Sequence
  Description of Artificial Sequence: Synthetic peptide
WYPCWLAHLGELCDLE

SEQ ID NO: 2700 - protein, 21 aa, Artificial Sequence
  Description of Artificial Sequence: Synthetic peptide
QVMRLWYPCWMAQLGELCDLE

SEQ ID NO: 2701 - protein, 22 aa, Artificial Sequence
  Description of Artificial Sequence: Synthetic peptide
WYPCWMAQLGELCDLDEAPVQP

SEQ ID NO: 2702 - protein, 22 aa, Artificial Sequence
  Description of Artificial Sequence: Synthetic peptide
RDIWWPCWVAQLGELCDLDDPQ

SEQ ID NO: 2703 - protein, 22 aa, Artificial Sequence
  Description of Artificial Sequence: Synthetic peptide
SATWYPCFLANLGELCDLEQEN

SEQ ID NO: 2704 - protein, 22 aa, Artificial Sequence
  Description of Artificial Sequence: Synthetic peptide
YAEWYPCWMARVGEVCDLEVTP

SEQ ID NO: 2705 - protein, 22 aa, Artificial Sequence
  Description of Artificial Sequence: Synthetic peptide
RSGDKAFFPCWLAQLGDLCDLD

SEQ ID NO: 2706 - protein, 16 aa, Artificial Sequence
  Description of Artificial Sequence: Synthetic peptide
WYPCWMAQLGELCDMD

SEQ ID NO: 2707 - protein, 21 aa, Artificial Sequence
  Description of Artificial Sequence: Synthetic peptide
RVSYPCWLARLGELCDMDLEE

SEQ ID NO: 2708 - protein, 22 aa, Artificial Sequence
  Description of Artificial Sequence: Synthetic peptide
TESWYPCWLANLGDLCDLEWSA

SEQ ID NO: 2709 - protein, 16 aa, Artificial Sequence
  Description of Artificial Sequence: Synthetic peptide
WLPCWMADVGDLCDLD

SEQ ID NO: 2710 - protein, 16 aa, Artificial Sequence
  Description of Artificial Sequence: Synthetic peptide
WHPCWMARLGELCDLD

SEQ ID NO: 2711 - protein, 22 aa, Artificial Sequence
  Description of Artificial Sequence: Synthetic peptide
QGTKWHWNPCWMAQLGELCDLD

SEQ ID NO: 2712 - protein, 22 aa, Artificial Sequence
  Description of Artificial Sequence: Synthetic peptide
KNGPKSWYPCWMAQVGDLCDLD

SEQ ID NO: 2713 - protein, 22 aa, Artificial Sequence
  Description of Artificial Sequence: Synthetic peptide
SGTGPAWYPCFLASLGQLCDLE

SEQ ID NO: 2714 - protein, 16 aa, Artificial Sequence
  Description of Artificial Sequence: Synthetic peptide
WYPCWMARMGELCDLE

SEQ ID NO: 2715 - protein, 16 aa, Artificial Sequence
  Description of Artificial Sequence: Synthetic peptide
WLPCWRAQLGQLCDLD

SEQ ID NO: 2716 - protein, 16 aa, Artificial Sequence
  Description of Artificial Sequence: Synthetic peptide
LFPCWLAQLGELCDLE

SEQ ID NO: 2717 - protein, 16 aa, Artificial Sequence
  Description of Artificial Sequence: Synthetic peptide
RYPCWIAQLGELCDLD

SEQ ID NO: 2718 - protein, 16 aa, Artificial Sequence
  Description of Artificial Sequence: Synthetic peptide
WHPCWIAHLGELCDLE

SEQ ID NO: 2719 - protein, 16 aa, Artificial Sequence
  Description of Artificial Sequence: Synthetic peptide
MYPCWIAHLGELCDLD

SEQ ID NO: 2720 - protein, 16 aa, Artificial Sequence
  Description of Artificial Sequence: Synthetic peptide
WYPCSIASLGELCDLE

SEQ ID NO: 2721 - protein, 16 aa, Artificial Sequence
  Description of Artificial Sequence: Synthetic peptide
WLPCYMAQLGDLCDLE

SEQ ID NO: 2722 - protein, 16 aa, Artificial Sequence
  Description of Artificial Sequence: Synthetic peptide
WHPCWMAQVGEVCDLD

SEQ ID NO: 2723 - protein, 16 aa, Artificial Sequence
  Description of Artificial Sequence: Synthetic peptide
WYPCWLASLGEVCDLE

SEQ ID NO: 2724 - protein, 16 aa, Artificial Sequence
  Description of Artificial Sequence: Synthetic peptide
WWPCSIARLGQLCDLD

SEQ ID NO: 2725 - protein, 16 aa, Artificial Sequence
  Description of Artificial Sequence: Synthetic peptide
WYPCWLAHLGELCDLA

SEQ ID NO: 2726 - protein, 16 aa, Artificial Sequence
  Description of Artificial Sequence: Synthetic peptide
WYPCWLAQLGELCDAE

SEQ ID NO: 2727 - protein, 16 aa, Artificial Sequence
  Description of Artificial Sequence: Synthetic peptide
WKPCWMALLGELCDLE

SEQ ID NO: 2728 - protein, 16 aa, Artificial Sequence
  Description of Artificial Sequence: Synthetic peptide
RYPCWRAKLGELCDLD

SEQ ID NO: 2729 - protein, 22 aa, Artificial Sequence
  Description of Artificial Sequence: Synthetic peptide
EEQSRGFLPCWMALLGELCDLD

SEQ ID NO: 2730 - protein, 22 aa, Artificial Sequence
  Description of Artificial Sequence: Synthetic peptide
LGSKRQWYPCWVAHLGELCDLE

SEQ ID NO: 2731 - protein, 22 aa, Artificial Sequence
  Description of Artificial Sequence: Synthetic peptide
ESEGRGWYPCWNALLGELCDLE

SEQ ID NO: 2732 - protein, 22 aa, Artificial Sequence
  Description of Artificial Sequence: Synthetic peptide
RWTQAQWYPCWLAQLGELCDLE

SEQ ID NO: 2733 - protein, 21 aa, Artificial Sequence
  Description of Artificial Sequence: Synthetic peptide
LHAGRWNPCWLAQLGELCDLE

SEQ ID NO: 2734 - protein, 21 aa, Artificial Sequence
  Description of Artificial Sequence: Synthetic peptide
LSSKGWYPCWKARLGDLCDLE

SEQ ID NO: 2735 - protein, 22 aa, Artificial Sequence
  Description of Artificial Sequence: Synthetic peptide
DMFTHRWYPCSMAKLGELCDLE

SEQ ID NO: 2736 - protein, 22 aa, Artificial Sequence
  Description of Artificial Sequence: Synthetic peptide
MTDRAFWNPCWVARLGELCDLD

SEQ ID NO: 2737 - protein, 22 aa, Artificial Sequence
  Description of Artificial Sequence: Synthetic peptide
NVTYTQWFPCWLARLGELCDLV

SEQ ID NO: 2738 - protein, 21 aa, Artificial Sequence
  Description of Artificial Sequence: Synthetic peptide
VRTRIWYPCWSAQLGELCDLD

SEQ ID NO: 2739 - protein, 21 aa, Artificial Sequence
  Description of Artificial Sequence: Synthetic peptide
AMARRYLPCWIAKLGELCELD

SEQ ID NO: 2740 - protein, 22 aa, Artificial Sequence
  Description of Artificial Sequence: Synthetic peptide
ARGEYRWFPCWMARLGELCDLE

SEQ ID NO: 2741 - protein, 22 aa, Artificial Sequence
  Description of Artificial Sequence: Synthetic peptide
YLERSRWYPCFIAQLGELCDLE

SEQ ID NO: 2742 - protein, 22 aa, Artificial Sequence
  Description of Artificial Sequence: Synthetic peptide
FRVSRDWFPCWMAQLGEVCDLE

SEQ ID NO: 2743 - protein, 22 aa, Artificial Sequence
  Description of Artificial Sequence: Synthetic peptide
IERAWEWRPCWLASVGELCDLE

SEQ ID NO: 2744 - protein, 21 aa, Artificial Sequence
  Description of Artificial Sequence: Synthetic peptide
VASERFYPCWIARLGELCDVE

SEQ ID NO: 2745 - protein, 22 aa, Artificial Sequence
  Description of Artificial Sequence: Synthetic peptide
WYPCWIAKLGEVCDLDQGTTRQ

SEQ ID NO: 2746 - protein, 22 aa, Artificial Sequence
  Description of Artificial Sequence: Synthetic peptide
WYPCWLAHLGELCDLDWKGRND

SEQ ID NO: 2747 - protein, 22 aa, Artificial Sequence
  Description of Artificial Sequence: Synthetic peptide
WYPCWRAQLGELCDLVDLGSHL

SEQ ID NO: 2748 - protein, 22 aa, Artificial Sequence
  Description of Artificial Sequence: Synthetic peptide
WSPCWMASLGDLCDLEETRQTE

SEQ ID NO: 2749 - protein, 22 aa, Artificial Sequence
  Description of Artificial Sequence: Synthetic peptide
WTPCWIAQLGELCDLEGRHGTV

SEQ ID NO: 2750 - protein, 21 aa, Artificial Sequence
  Description of Artificial Sequence: Synthetic peptide
LPCWIAQLGDLCDLEPEPSPE

SEQ ID NO: 2751 - protein, 22 aa, Artificial Sequence
  Description of Artificial Sequence: Synthetic peptide
FYPCWAAHLGDLCDLEYQEAGP

SEQ ID NO: 2752 - protein, 22 aa, Artificial Sequence
  Description of Artificial Sequence: Synthetic peptide
WLPCWLAPLGDLCDMDMSAVMN

SEQ ID NO: 2753 - protein, 22 aa, Artificial Sequence
  Description of Artificial Sequence: Synthetic peptide
WRPCWMAHLGDLCDLEMANENP

SEQ ID NO: 2754 - protein, 22 aa, Artificial Sequence
  Description of Artificial Sequence: Synthetic peptide
WYPCWLAQLGEVCDLDDGGGVF

SEQ ID NO: 2755 - protein, 22 aa, Artificial Sequence
  Description of Artificial Sequence: Synthetic peptide
WWPCWLAQLGELCDLEVNGSLI

SEQ ID NO: 2756 - protein, 22 aa, Artificial Sequence
  Description of Artificial Sequence: Synthetic peptide
TEMWYPCWMAYQGELCDLDMTY

SEQ ID NO: 2757 - protein, 22 aa, Artificial Sequence
  Description of Artificial Sequence: Synthetic peptide
ARTWWPCWRAKLGELCDLVVPE

SEQ ID NO: 2758 - protein, 22 aa, Artificial Sequence
  Description of Artificial Sequence: Synthetic peptide
HQGFYSCRLARLGELCDLDTGW

SEQ ID NO: 2759 - protein, 22 aa, Artificial Sequence
  Description of Artificial Sequence: Synthetic peptide
VDEFYPCSMAGLGELCDLERQN

SEQ ID NO: 2760 - protein, 22 aa, Artificial Sequence
  Description of Artificial Sequence: Synthetic peptide
AWDWYPCSVAALGEICDLDIQD

SEQ ID NO: 2761 - protein, 22 aa, Artificial Sequence
  Description of Artificial Sequence: Synthetic peptide
RPPWYPCWMARLGEVCDMDIML

SEQ ID NO: 2762 - protein, 22 aa, Artificial Sequence
  Description of Artificial Sequence: Synthetic peptide
SQRWYPCWVAHLGELCDLEGVV

SEQ ID NO: 2763 - protein, 22 aa, Artificial Sequence
  Description of Artificial Sequence: Synthetic peptide
KGSWQPCWFAKLGELCDLHPTS

SEQ ID NO: 2764 - protein, 22 aa, Artificial Sequence
  Description of Artificial Sequence: Synthetic peptide
QTWYLPCWMAKLGELCDLGERD

SEQ ID NO: 2765 - protein, 22 aa, Artificial Sequence
  Description of Artificial Sequence: Synthetic peptide
EPRWYPCWMAQMGELCDMEMSD

SEQ ID NO: 2766 - protein, 22 aa, Artificial Sequence
  Description of Artificial Sequence: Synthetic peptide
WGGRYWCWMAKLGDLCDLEDEW

SEQ ID NO: 2767 - protein, 22 aa, Artificial Sequence
  Description of Artificial Sequence: Synthetic peptide
WWPCWIAQVGELCDLDGPGRPT

SEQ ID NO: 2768 - protein, 19 aa, Artificial Sequence
  Description of Artificial Sequence: Synthetic peptide
RLVYDCLFAQVGDLCEVIS

SEQ ID NO: 2769 - protein, 20 aa, Artificial Sequence
  Description of Artificial Sequence: Synthetic peptide
WRILWMQQCWRSHVVNQCAL

SEQ ID NO: 2770 - protein, 22 aa, Artificial Sequence
  Description of Artificial Sequence: Synthetic peptide
WYPCWIAQVGELCDLDEVSHGR

SEQ ID NO: 2771 - protein, 22 aa, Artificial Sequence
  Description of Artificial Sequence: Synthetic peptide
TGEWWPCWVAEVGELCDLERGP

SEQ ID NO: 2772 - protein, 20 aa, Artificial Sequence
  Description of Artificial Sequence: Synthetic peptide
ARTQGWYDCLFAQVGELCDL

SEQ ID NO: 2773 - protein, 22 aa, Artificial Sequence
  Description of Artificial Sequence: Synthetic peptide
FHPCWRALLGELCDLETALGPS

SEQ ID NO: 2774 - protein, 20 aa, Artificial Sequence
  Description of Artificial Sequence: Synthetic peptide
LQIRKLWACRIDLVGPFCLL

SEQ ID NO: 2775 - protein, 20 aa, Artificial Sequence
  Description of Artificial Sequence: Synthetic peptide
AEYSGRYDCYIAKVGELCDI

SEQ ID NO: 2776 - protein, 20 aa, Artificial Sequence
  Description of Artificial Sequence: Synthetic peptide
SWRFLWQDCGRAHVGELCDL

SEQ ID NO: 2777 - protein, 22 aa, Artificial Sequence
  Description of Artificial Sequence: Synthetic peptide
NRWWHPCWMARVGELCDLEPDA

SEQ ID NO: 2778 - protein, 22 aa, Artificial Sequence
  Description of Artificial Sequence: Synthetic peptide
WWPCWVAKLGELCDLEGDASRV

SEQ ID NO: 2779 - protein, 22 aa, Artificial Sequence
  Description of Artificial Sequence: Synthetic peptide
WYPCEFAQLGELCDLLPFPYPA

SEQ ID NO: 2780 - protein, 20 aa, Artificial Sequence
  Description of Artificial Sequence: Synthetic peptide
SYMHDCFMAQVGDLCDRFIS

SEQ ID NO: 2781 - protein, 22 aa, Artificial Sequence
  Description of Artificial Sequence: Synthetic peptide
WWPCWIAQVGELCDLEEESRES

SEQ ID NO: 2782 - protein, 22 aa, Artificial Sequence
  Description of Artificial Sequence: Synthetic peptide
KWAWNPCYIARLGELCDLVEPE

SEQ ID NO: 2783 - protein, 22 aa, Artificial Sequence
  Description of Artificial Sequence: Synthetic peptide
WWPCWIADLGELCDLEGPPRGR

SEQ ID NO: 2784 - protein, 20 aa, Artificial Sequence
  Description of Artificial Sequence: Synthetic peptide
PTLITWYDCLFAEVGELCDM

SEQ ID NO: 2785 - protein, 20 aa, Artificial Sequence
  Description of Artificial Sequence: Synthetic peptide
EISNWFLDCMFADVGDLCDL

SEQ ID NO: 2786 - protein, 22 aa, Artificial Sequence
  Description of Artificial Sequence: Synthetic peptide
AQVWYPCWLAKVGELCDLDQWN

SEQ ID NO: 2787 - protein, 22 aa, Artificial Sequence
  Description of Artificial Sequence: Synthetic peptide
FGGKMDWYPCWIANLGELCDLK

SEQ ID NO: 2788 - protein, 22 aa, Artificial Sequence
  Description of Artificial Sequence: Synthetic peptide
WFPCWMAKVGDLCDVDEHQDPS

SEQ ID NO: 2789 - protein, 22 aa, Artificial Sequence
  Description of Artificial Sequence: Synthetic peptide
MGDSSSWFPCWMAQLGELCDME

SEQ ID NO: 2790 - protein, 22 aa, Artificial Sequence
  Description of Artificial Sequence: Synthetic peptide
MFRYYPCWIASIGELCDLEWGV

SEQ ID NO: 2791 - protein, 22 aa, Artificial Sequence
  Description of Artificial Sequence: Synthetic peptide
ERRWYPCWLASVGELCDLDMGD

SEQ ID NO: 2792 - protein, 16 aa, Artificial Sequence
  Description of Artificial Sequence: Synthetic peptide
WYPCWVAQLGELCDLE

SEQ ID NO: 2793 - protein, 22 aa, Artificial Sequence
  Description of Artificial Sequence: Synthetic peptide
RWDYWPCYIAQVGELCDLEVYE

SEQ ID NO: 2794 - protein, 22 aa, Artificial Sequence
  Description of Artificial Sequence: Synthetic peptide
SLAHRSWYPCWLAQVGELCDLD

SEQ ID NO: 2795 - protein, 22 aa, Artificial Sequence
  Description of Artificial Sequence: Synthetic peptide
QNASKGWYPCWIAHVGELCDWD

SEQ ID NO: 2796 - protein, 21 aa, Artificial Sequence
  Description of Artificial Sequence: Synthetic peptide
HRWYPCWLAHLGELCDLDPMS

SEQ ID NO: 2797 - protein, 16 aa, Artificial Sequence
  Description of Artificial Sequence: Synthetic peptide
FYPCWIAFVGELCDLE

SEQ ID NO: 2798 - protein, 20 aa, Artificial Sequence
  Description of Artificial Sequence: Synthetic peptide
EGHWYPCWIAQLGELCDLDW

SEQ ID NO: 2799 - protein, 22 aa, Artificial Sequence
  Description of Artificial Sequence: Synthetic peptide
WTGWSAFYPCSIANLGELCDLD

SEQ ID NO: 2800 - protein, 22 aa, Artificial Sequence
  Description of Artificial Sequence: Synthetic peptide
WEKLQNWYPCWIAQMGELCDLE

SEQ ID NO: 2801 - protein, 22 aa, Artificial Sequence
  Description of Artificial Sequence: Synthetic peptide
TNGVLDWWPCWMAQVGELCDLD

SEQ ID NO: 2802 - protein, 16 aa, Artificial Sequence
  Description of Artificial Sequence: Synthetic peptide
WYPCWVAKLGELCDLE

SEQ ID NO: 2803 - protein, 19 aa, Artificial Sequence
  Description of Artificial Sequence: Synthetic peptide
AYYPCELAQLGELCDLYNI

SEQ ID NO: 2804 - protein, 16 aa, Artificial Sequence
  Description of Artificial Sequence: Synthetic peptide
WYPCWMAHLGELCDLE

SEQ ID NO: 2805 - protein, 21 aa, Artificial Sequence
  Description of Artificial Sequence: Synthetic peptide
NDHTAWWPCYFAQVGDLCDLV

SEQ ID NO: 2806 - protein, 22 aa, Artificial Sequence
  Description of Artificial Sequence: Synthetic peptide
WWPCEIAQIGELCDLEWVRHAE

SEQ ID NO: 2807 - protein, 22 aa, Artificial Sequence
  Description of Artificial Sequence: Synthetic peptide
WWPCDFAQIGELCDLGPRFTGE

SEQ ID NO: 2808 - protein, 22 aa, Artificial Sequence
  Description of Artificial Sequence: Synthetic peptide
RDWWLPCEFALIGELCDLERSW

SEQ ID NO: 2809 - protein, 20 aa, Artificial Sequence
  Description of Artificial Sequence: Synthetic peptide
MRTTFWYDCYIAQVGELCDF

SEQ ID NO: 2810 - protein, 22 aa, Artificial Sequence
  Description of Artificial Sequence: Synthetic peptide
SWHAETWYPCWLAQVGELCDLD

SEQ ID NO: 2811 - protein, 20 aa, Artificial Sequence
  Description of Artificial Sequence: Synthetic peptide
EWFHDCFLAKVGDLCDLFLW

SEQ ID NO: 2812 - protein, 22 aa, Artificial Sequence
  Description of Artificial Sequence: Synthetic peptide
SGKTQMWNPCYVAKVGELCDLV

SEQ ID NO: 2813 - protein, 22 aa, Artificial Sequence
  Description of Artificial Sequence: Synthetic peptide
DKAGPNFYPCWLAHVGELCDQA

SEQ ID NO: 2814 - protein, 22 aa, Artificial Sequence
  Description of Artificial Sequence: Synthetic peptide
AGFRGRWWPCEYAQVGELCDLE

SEQ ID NO: 2815 - protein, 22 aa, Artificial Sequence
  Description of Artificial Sequence: Synthetic peptide
WFPCWLAKVGELCDRDDLAGPS

SEQ ID NO: 2816 - protein, 16 aa, Artificial Sequence
  Description of Artificial Sequence: Synthetic peptide
WWPCEWARIGELCDLE

SEQ ID NO: 2817 - protein, 20 aa, Artificial Sequence
  Description of Artificial Sequence: Synthetic peptide
KGSSWFPCYFAQVGDLCDLY

SEQ ID NO: 2818 - protein, 16 aa, Artificial Sequence
  Description of Artificial Sequence: Synthetic peptide
WYPCWLAQVGELCDRE

SEQ ID NO: 2819 - protein, 21 aa, Artificial Sequence
  Description of Artificial Sequence: Synthetic peptide
RGVYFPCWLAKVGDLCDSDEF

SEQ ID NO: 2820 - protein, 22 aa, Artificial Sequence
  Description of Artificial Sequence: Synthetic peptide
RAWWWPCELAQVGELCDLEPSS

SEQ ID NO: 2821 - protein, 16 aa, Artificial Sequence
  Description of Artificial Sequence: Synthetic peptide
WYPCWLAKVGELCDQE

SEQ ID NO: 2822 - protein, 20 aa, Artificial Sequence
  Description of Artificial Sequence: Synthetic peptide
RYVPDCLKAQVGDLCDFFAW

SEQ ID NO: 2823 - protein, 16 aa, Artificial Sequence
  Description of Artificial Sequence: Synthetic peptide
WWPCYLAQIGELCDLV

SEQ ID NO: 2824 - protein, 16 aa, Artificial Sequence
  Description of Artificial Sequence: Synthetic peptide
WYPCWMAKVGELCDME

SEQ ID NO: 2825 - protein, 22 aa, Artificial Sequence
  Description of Artificial Sequence: Synthetic peptide
QITDSGWYPCWVAKVGELCDMD

SEQ ID NO: 2826 - protein, 22 aa, Artificial Sequence
  Description of Artificial Sequence: Synthetic peptide
YRWWYPCDIAQVGELCDLDYLL

SEQ ID NO: 2827 - protein, 20 aa, Artificial Sequence
  Description of Artificial Sequence: Synthetic peptide
CYMHDCFMAQVGDLCDRFIS

SEQ ID NO: 2828 - protein, 16 aa, Artificial Sequence
  Description of Artificial Sequence: Synthetic peptide
WLPCWIAKIGDLCDLD

SEQ ID NO: 2829 - protein, 22 aa, Artificial Sequence
  Description of Artificial Sequence: Synthetic peptide
SRVWHPCWLARVGELCDLEVSD

SEQ ID NO: 2830 - protein, 22 aa, Artificial Sequence
  Description of Artificial Sequence: Synthetic peptide
WEHEFTWYPCWIAQVGELCDMD

SEQ ID NO: 2831 - protein, 22 aa, Artificial Sequence
  Description of Artificial Sequence: Synthetic peptide
HRGWVGWYPCEYALPGQLCDLE

SEQ ID NO: 2832 - protein, 21 aa, Artificial Sequence
  Description of Artificial Sequence: Synthetic peptide
WYPCWLAQLGELCDQDWDTPS

SEQ ID NO: 2833 - protein, 22 aa, Artificial Sequence
  Description of Artificial Sequence: Synthetic peptide
RVRRHSWWPCEIAVVGELCDLE

SEQ ID NO: 2834 - protein, 21 aa, Artificial Sequence
  Description of Artificial Sequence: Synthetic peptide
DGWWPCWIAQVGELCDLEDPV

SEQ ID NO: 2835 - protein, 20 aa, Artificial Sequence
  Description of Artificial Sequence: Synthetic peptide
LPFQDCYIAQVGELCDLPGT

SEQ ID NO: 2836 - protein, 20 aa, Artificial Sequence
  Description of Artificial Sequence: Synthetic peptide
RWMFDCLFARVGELCDIRPW

SEQ ID NO: 2837 - protein, 20 aa, Artificial Sequence
  Description of Artificial Sequence: Synthetic peptide
GGYYDCLIAEVGELCDMPGQ

SEQ ID NO: 2838 - protein, 20 aa, Artificial Sequence
  Description of Artificial Sequence: Synthetic peptide
VVCYACDIAHVGELCDLTCR

SEQ ID NO: 2839 - protein, 20 aa, Artificial Sequence
  Description of Artificial Sequence: Synthetic peptide
TPWYDCYIANVGDLCDFASA

SEQ ID NO: 2840 - protein, 20 aa, Artificial Sequence
  Description of Artificial Sequence: Synthetic peptide
LESLDCFFARIGDLCEIWDV

SEQ ID NO: 2841 - protein, 20 aa, Artificial Sequence
  Description of Artificial Sequence: Synthetic peptide
WQIFDCYLAQVGELCDLQDT

SEQ ID NO: 2842 - protein, 20 aa, Artificial Sequence
  Description of Artificial Sequence: Synthetic peptide
GRYPDCYIAHVGELCEFYDG

SEQ ID NO: 2843 - protein, 20 aa, Artificial Sequence
  Description of Artificial Sequence: Synthetic peptide
FGDDFCRFIPLFEMCTTDVE

SEQ ID NO: 2844 - protein, 20 aa, Artificial Sequence
  Description of Artificial Sequence: Synthetic peptide
LVYYDCYMAQVGELCDLPSL

SEQ ID NO: 2845 - protein, 20 aa, Artificial Sequence
  Description of Artificial Sequence: Synthetic peptide
VSRYDCYIAKVGELCDFFEF

SEQ ID NO: 2846 - protein, 20 aa, Artificial Sequence
  Description of Artificial Sequence: Synthetic peptide
VTVQDCYFARVGDLCDLFSP

SEQ ID NO: 2847 - protein, 20 aa, Artificial Sequence
  Description of Artificial Sequence: Synthetic peptide
WEWYDCLMAQVGELCDFEGN

SEQ ID NO: 2848 - protein, 20 aa, Artificial Sequence
  Description of Artificial Sequence: Synthetic peptide
WAFYDCRNAQVGDFCDLWEF

SEQ ID NO: 2849 - protein, 20 aa, Artificial Sequence
  Description of Artificial Sequence: Synthetic peptide
SMDQDCYFAQVGELCVLFNQ

SEQ ID NO: 2850 - protein, 20 aa, Artificial Sequence
  Description of Artificial Sequence: Synthetic peptide
GGYYDCLIAEVGELCDIYGR

SEQ ID NO: 2851 - protein, 20 aa, Artificial Sequence
  Description of Artificial Sequence: Synthetic peptide
SNWHDCLFAQVGELCDLPGS

SEQ ID NO: 2852 - protein, 14 aa, Artificial Sequence
  Description of Artificial Sequence: Synthetic peptide
YDCYIAQVGELCDI

SEQ ID NO: 2853 - protein, 20 aa, Artificial Sequence
  Description of Artificial Sequence: Synthetic peptide
SWLSDLQDCYIAQVGDLCQI

SEQ ID NO: 2854 - skipped

SEQ ID NO: 2855 - protein, 20 aa, Artificial Sequence
  Description of Artificial Sequence: Synthetic peptide
RLASDWWDCYIAKVGELCDF

SEQ ID NO: 2856 - protein, 20 aa, Artificial Sequence
  Description of Artificial Sequence: Synthetic peptide
RLLRDCFLAKVGDLCELFVW

SEQ ID NO: 2857 - protein, 20 aa, Artificial Sequence
  Description of Artificial Sequence: Synthetic peptide
QWFHNCFLARVGDTCDLFLW

SEQ ID NO: 2858 - protein, 20 aa, Artificial Sequence
  Description of Artificial Sequence: Synthetic peptide
ELLVDCFKVKVGELCDLFFG

SEQ ID NO: 2859 - protein, 20 aa, Artificial Sequence
  Description of Artificial Sequence: Synthetic peptide
RYVHDCFIAQVGDLCDLFLH

SEQ ID NO: 2860 - protein, 20 aa, Artificial Sequence
  Description of Artificial Sequence: Synthetic peptide
KWVHDCFLAKVGDVCDLFVV

SEQ ID NO: 2861 - protein, 20 aa, Artificial Sequence
  Description of Artificial Sequence: Synthetic peptide
RSLVDCFLVKVGDLCDFFNW

SEQ ID NO: 2862 - protein, 20 aa, Artificial Sequence
  Description of Artificial Sequence: Synthetic peptide
RYLYDCFLALVGDLCVKFHQ

SEQ ID NO: 2863 - protein, 20 aa, Artificial Sequence
  Description of Artificial Sequence: Synthetic peptide
AHFYDCFWAKAGELCDLWPS

SEQ ID NO: 2864 - protein, 20 aa, Artificial Sequence
  Description of Artificial Sequence: Synthetic peptide
KWFHDCFLAKVGDLCDLFLW

SEQ ID NO: 2865 - protein, 22 aa, Artificial Sequence
  Description of Artificial Sequence: Synthetic peptide
WGKLVRDCFLAKVGDLCDLFLW

SEQ ID NO: 2866 - protein, 20 aa, Artificial Sequence
  Description of Artificial Sequence: Synthetic peptide
THVHDCFLAKVGDLCDLFIV

SEQ ID NO: 2867 - protein, 20 aa, Artificial Sequence
  Description of Artificial Sequence: Synthetic peptide
HWVRDCFLAKVGELCDLFLW

SEQ ID NO: 2868 - protein, 20 aa, Artificial Sequence
  Description of Artificial Sequence: Synthetic peptide
HGILDCYFAKVGELCELFDW

SEQ ID NO: 2869 - protein, 20 aa, Artificial Sequence
  Description of Artificial Sequence: Synthetic peptide
QFVKDCFLAQVGDLCELFLW

SEQ ID NO: 2870 - protein, 20 aa, Artificial Sequence
  Description of Artificial Sequence: Synthetic peptide
DWLPDCYFANVGDLCSLFGS

SEQ ID NO: 2871 - protein, 20 aa, Artificial Sequence
  Description of Artificial Sequence: Synthetic peptide
HWFLDCFLANVGDLCDFFGN

SEQ ID NO: 2872 - protein, 20 aa, Artificial Sequence
  Description of Artificial Sequence: Synthetic peptide
NWLPDCLFANVGELCDIFPW

SEQ ID NO: 2873 - protein, 20 aa, Artificial Sequence
  Description of Artificial Sequence: Synthetic peptide
EIFKDCLFANVGELCEIFPS

SEQ ID NO: 2874 - protein, 20 aa, Artificial Sequence
  Description of Artificial Sequence: Synthetic peptide
NWFHDCFLARVGDLCDLFLD

SEQ ID NO: 2875 - protein, 20 aa, Artificial Sequence
  Description of Artificial Sequence: Synthetic peptide
YSFKDCYFAKVGELCELFLW

SEQ ID NO: 2876 - protein, 20 aa, Artificial Sequence
  Description of Artificial Sequence: Synthetic peptide
EFFHDCYVARVGELCDLFGW

SEQ ID NO: 2877 - protein, 16 aa, Artificial Sequence
  Description of Artificial Sequence: Synthetic peptide
SYLCWLDHWGVICEED

SEQ ID NO: 2878 - protein, 16 aa, Artificial Sequence
  Description of Artificial Sequence: Synthetic peptide
WYTCMMDWLGVHCELE

SEQ ID NO: 2879 - protein, 22 aa, Artificial Sequence
  Description of Artificial Sequence: Synthetic peptide
QMVWWDCWSTQEGPVCELNWTA

SEQ ID NO: 2880 - protein, 20 aa, Artificial Sequence
  Description of Artificial Sequence: Synthetic peptide
YWCSVWQLGSVCEMNNEETQ

SEQ ID NO: 2881 - protein, 22 aa, Artificial Sequence
  Description of Artificial Sequence: Synthetic peptide
WTCWLTQLGYDCNLDVVDQSLG

SEQ ID NO: 2882 - protein, 22 aa, Artificial Sequence
  Description of Artificial Sequence: Synthetic peptide
DGSWYTCWFTQLGEWCEQDDAK

SEQ ID NO: 2883 - protein, 22 aa, Artificial Sequence
  Description of Artificial Sequence: Synthetic peptide
EFWGWQCWQEPLGWSCDLEWMD

SEQ ID NO: 2884 - protein, 16 aa, Artificial Sequence
  Description of Artificial Sequence: Synthetic peptide
WYPCWIARVGELCDLE

SEQ ID NO: 2885 - protein, 16 aa, Artificial Sequence
  Description of Artificial Sequence: Synthetic peptide
WYPCWLAQVGELCDLD

SEQ ID NO: 2886 - protein, 16 aa, Artificial Sequence
  Description of Artificial Sequence: Synthetic peptide
LVDCFKVKVGELCDLF

SEQ ID NO: 2887 - protein, 16 aa, Artificial Sequence
  Description of Artificial Sequence: Synthetic peptide
VHDCFIAQVGDLCDLF

SEQ ID NO: 2888 - protein, 14 aa, Artificial Sequence
  Description of Artificial Sequence: Synthetic peptide
WPCWAALGELCDLD

SEQ ID NO: 2889 - protein, 13 aa, Artificial Sequence
  Description of Artificial Sequence: Synthetic peptide
WPCWALGELCDLD

SEQ ID NO: 2890 - protein, 12 aa, Artificial Sequence
  Description of Artificial Sequence: Synthetic peptide
WPCWLGELCDLD

SEQ ID NO: 2891 - protein, 12 aa, Artificial Sequence
  Description of Artificial Sequence: Synthetic peptide
WYPCWGELCDLD

SEQ ID NO: 2892-2899 - skipped (8 entries)

SEQ ID NO: 2900 - protein, 20 aa, Artificial Sequence
  Description of Artificial Sequence: Synthetic peptide
  MOD_RES (1)..(1): A, D, E, H, K, N, Q, R, or T
  MOD_RES (2)..(2): F, G, H, I, L, S, W, or Y
  MOD_RES (3)..(3): F, I, L, or V
  MOD_RES (4)..(4): H, K, L, P, R, V, or Y
  MOD_RES (7)..(7): F, L, or Y
  MOD_RES (8)..(8): F, I, K, L, V, or W
  MOD_RES (9)..(9): A or V
  MOD_RES (10)..(10): K, L, N, Q, or R
  MOD_RES (11)..(11): A or V
  MOD_RES (13)..(13): D or E
  MOD_RES (14)..(14): L, T, or V
  MOD_RES (16)..(16): D, E, S, or V
  MOD_RES (17)..(17): F, I, K, or L
  MOD_RES (18)..(18): F or W
  MOD_RES (19)..(19): D, F, G, I, L, N, P, or V
  MOD_RES (20)..(20): D, G, H, N, Q, S V, or W
XXXXDCXXXXXGXXCXXXXX

SEQ ID NO: 2901 - protein, 18 aa, Artificial Sequence
  Description of Artificial Sequence: Synthetic peptide
  MOD_RES (1)..(1): F, G, H, I, L, S, W, or Y
  MOD_RES (2)..(2): F, I, L, or V
  MOD_RES (3)..(3): H, K, L, P, R, V, or Y
  MOD_RES (6)..(6): F, L, or Y
  MOD_RES (7)..(7): F, I, K, L, V, or W
  MOD_RES (8)..(8): A or V
  MOD_RES (9)..(9): K, L, N, Q, or R
  MOD_RES (10)..(10): A or V
  MOD_RES (12)..(12): D or E
  MOD_RES (13)..(13): L, T, or V
  MOD_RES (15)..(15): D, E, S, or V
  MOD_RES (16)..(16): F, I, K, or L
  MOD_RES (17)..(17): F or W
  MOD_RES (18)..(18): D, F, G, I, L, N, P, or V
XXXDCXXXXXGXXCXXXX

SEQ ID NO: 2902 - protein, 16 aa, Artificial Sequence
  Description of Artificial Sequence: Synthetic peptide
  MOD_RES (1)..(1): F, I, L, or V
  MOD_RES (2)..(2): H, K, L, P, R, V, or Y
  MOD_RES (5)..(5): F, L, or Y
  MOD_RES (6)..(6): F, I, K, L, V, or W
  MOD_RES (7)..(7): A or V
  MOD_RES (8)..(8): K, L, N, Q, or R
  MOD_RES (9)..(9): A or V
  MOD_RES (11)..(11): D or E
  MOD_RES (12)..(12): L, T, or V
  MOD_RES (14)..(14): D, E, S, or V
  MOD_RES (15)..(15): F, I, K, or L
  MOD_RES (16)..(16): F or W
XXDCXXXXXGXXCXXX

SEQ ID NO: 2903 - protein, 14 aa, Artificial Sequence
  Description of Artificial Sequence: Synthetic peptide
  MOD_RES (1)..(1): H, K, L, P, R, V, or Y
  MOD_RES (4)..(4): F, L, or Y
  MOD_RES (5)..(5): F, I, K, L, V, or W
  MOD_RES (6)..(6): A or V
  MOD_RES (7)..(7): K, L, N, Q, or R
  MOD_RES (8)..(8): A or V
  MOD_RES (10)..(10): D or E
  MOD_RES (11)..(11): L, T, or V
  MOD_RES (13)..(13): D, E, S, or V
  MOD_RES (14)..(14): F, I, K, or L
XDCXXXXXGXXCXX

SEQ ID NO: 2904 - protein, 12 aa, Artificial Sequence
  Description of Artificial Sequence: Synthetic peptide
  MOD_RES (3)..(3): F, L, or Y
  MOD_RES (4)..(4): F, I, K, L, V, or W
  MOD_RES (5)..(5): A or V
  MOD_RES (6)..(6): K, L, N, Q, or R
  MOD_RES (7)..(7): A or V
  MOD_RES (9)..(9): D or E
  MOD_RES (10)..(10): L, T, or V
  MOD_RES (12)..(12): D, E, S, or V
DCXXXXXGXXCX

SEQ ID NO: 2905 - protein, 10 aa, Artificial Sequence
  Description of Artificial Sequence: Synthetic peptide
  MOD_RES (2)..(2): F, L, or Y
  MOD_RES (3)..(3): F, I, K, L, V, or W
  MOD_RES (4)..(4): A or V
  MOD_RES (5)..(5): K, L, N, Q, or R
  MOD_RES (6)..(6): A or V
  MOD_RES (8)..(8): D or E
  MOD_RES (9)..(9): L, T, or V
CXXXXXGXXC

SEQ ID NO: 2906 - protein, 8 aa, Artificial Sequence
  Description of Artificial Sequence: Synthetic peptide
  MOD_RES (1)..(1): F, L, or Y
  MOD_RES (2)..(2): F, I, K, L, V, or W
  MOD_RES (3)..(3): A or V
  MOD_RES (4)..(4): K, L, N, Q, or R
  MOD_RES (5)..(5): A or V
  MOD_RES (7)..(7): D or E
  MOD_RES (8)..(8): L, T, or V
XXXXXGXX

SEQ ID NO: 2907 - protein, 20 aa, Artificial Sequence
  Description of Artificial Sequence: Synthetic peptide
AFFHDCFFAKAGDLCDFFDD

SEQ ID NO: 2908 - protein, 20 aa, Artificial Sequence
  Description of Artificial Sequence: Synthetic peptide
DFFHDCFFAKVGDLCDFFFG

SEQ ID NO: 2909 - protein, 20 aa, Artificial Sequence
  Description of Artificial Sequence: Synthetic peptide
EGFHDCFFAKVGDLCDIFGH

SEQ ID NO: 2910 - protein, 20 aa, Artificial Sequence
  Description of Artificial Sequence: Synthetic peptide
EHFHDCFFAKVGDLCDIFGN

SEQ ID NO: 2911 - protein, 20 aa, Artificial Sequence
  Description of Artificial Sequence: Synthetic peptide
EHFHDCFFAKVGDLCDKFGQ

SEQ ID NO: 2912 - protein, 20 aa, Artificial Sequence
  Description of Artificial Sequence: Synthetic peptide
HIFHDCFIAKVGDLCDLFHS

SEQ ID NO: 2913 - protein, 20 aa, Artificial Sequence
  Description of Artificial Sequence: Synthetic peptide
HLFHDCFKAKVGDLCDLFIS

SEQ ID NO: 2914 - protein, 20 aa, Artificial Sequence
  Description of Artificial Sequence: Synthetic peptide
HLFKDCFLAKVGDLCDLFLS

SEQ ID NO: 2915 - protein, 22 aa, Artificial Sequence
  Description of Artificial Sequence: Synthetic peptide
WGKSIKDCFLAKVGDLCDLFLV

SEQ ID NO: 2916 - protein, 20 aa, Artificial Sequence
  Description of Artificial Sequence: Synthetic peptide
KSLKDCFLAKVGDLCDLFLV

SEQ ID NO: 2917 - protein, 20 aa, Artificial Sequence
  Description of Artificial Sequence: Synthetic peptide
KWLLDCFLALVGDLCDLFLW

SEQ ID NO: 2918 - protein, 20 aa, Artificial Sequence
  Description of Artificial Sequence: Synthetic peptide
NWLLDCFLANVGDLCDLFLW

SEQ ID NO: 2919 - protein, 20 aa, Artificial Sequence
  Description of Artificial Sequence: Synthetic peptide
NWLPDCFLANVGELCDLFLW

SEQ ID NO: 2920 - protein, 20 aa, Artificial Sequence
  Description of Artificial Sequence: Synthetic peptide
QWLPDCFLANVGELCDLFLW

SEQ ID NO: 2921 - protein, 20 aa, Artificial Sequence
  Description of Artificial Sequence: Synthetic peptide
QWVRDCLLANVGELCELFLW

SEQ ID NO: 2922 - protein, 20 aa, Artificial Sequence
  Description of Artificial Sequence: Synthetic peptide
RWVRDCLLAQVGELCELFNW

SEQ ID NO: 2923 - protein, 20 aa, Artificial Sequence
  Description of Artificial Sequence: Synthetic peptide
RWVVDCYLAQVGELCELFPW

SEQ ID NO: 2924 - protein, 20 aa, Artificial Sequence
  Description of Artificial Sequence: Synthetic peptide
RWVVDCYLARVGELCELFPW

SEQ ID NO: 2925 - protein, 20 aa, Artificial Sequence
  Description of Artificial Sequence: Synthetic peptide
TYVYDCYVVRVGETCSLFPW

SEQ ID NO: 2926 - protein, 20 aa, Artificial Sequence
  Description of Artificial Sequence: Synthetic peptide
YYVYNCYWVRVGEVCVLWVW

SEQ ID NO: 2927-2929 - skipped (3 entries)

SEQ ID NO: 2930 - protein, 24 aa, Artificial Sequence
  Description of Artificial Sequence: Synthetic peptide
GGWYPCWIARVGELCDLEEGPVNR

SEQ ID NO: 2931 - protein, 23 aa, Artificial Sequence
  Description of Artificial Sequence: Synthetic peptide
GGAVEFYPCWLARIGELCDLVEP

SEQ ID NO: 2932 - protein, 18 aa, Artificial Sequence
  Description of Artificial Sequence: Synthetic peptide
GGWYPCWIARVGELCDME

SEQ ID NO: 2933 - protein, 25 aa, Artificial Sequence
  Description of Artificial Sequence: Synthetic peptide
GGEWFHDCFLAKVGDLCDLFLGGEW

SEQ ID NO: 2934 - protein, 22 aa, Artificial Sequence
  Description of Artificial Sequence: Synthetic peptide
GGRYVHDCFIAQVGDLCDLFLH

SEQ ID NO: 2935 - protein, 22 aa, Artificial Sequence
  Description of Artificial Sequence: Synthetic peptide
GGRSLVDCFLVKVGDLCDFFNW

SEQ ID NO: 2936 - protein, 18 aa, Artificial Sequence
  Description of Artificial Sequence: Synthetic peptide
GGWYPCWIARVGELCDLE

SEQ ID NO: 2937 - protein, 18 aa, Artificial Sequence
  Description of Artificial Sequence: Synthetic peptide
GGWYPCWLAQVGELCDLD

SEQ ID NO: 2938 - protein, 18 aa, Artificial Sequence
  Description of Artificial Sequence: Synthetic peptide
GGLVDCFKVKVGELCDLF

SEQ ID NO: 2939 - protein, 18 aa, Artificial Sequence
  Description of Artificial Sequence: Synthetic peptide
GGWYSCWMAQLGELCDLD

SEQ ID NO: 2940-4069 - skipped (1130 entries)

SEQ ID NO: 4070 - protein, 47 aa, Artificial Sequence
  Description of Artificial Sequence: Synthetic polypeptide
GGWYPCWIARVGELCDLEEGPVNRGGGGSGGVVCQDWEGVELCWQGG

SEQ ID NO: 4071 - protein, 46 aa, Artificial Sequence
  Description of Artificial Sequence: Synthetic polypeptide
GGAVEFYPCWLARIGELCDLVEPGGGGSGGVVCQDWEGVELCWQGG

SEQ ID NO: 4072 - protein, 41 aa, Artificial Sequence
  Description of Artificial Sequence: Synthetic polypeptide
GGWYPCWIARVGELCDMEGGGGSGGVVCQDWEGVELCWQGG

SEQ ID NO: 4073 - protein, 45 aa, Artificial Sequence
  Description of Artificial Sequence: Synthetic polypeptide
GGEWFHDCFLAKVGDLCDLFLWGGGGSGGVVCQDWEGVELCWQGG

SEQ ID NO: 4074 - protein, 45 aa, Artificial Sequence
  Description of Artificial Sequence: Synthetic polypeptide
GGRYVHDCFIAQVGDLCDLFLHGGGGSGGVVCQDWEGVELCWQGG

SEQ ID NO: 4075 - protein, 45 aa, Artificial Sequence
  Description of Artificial Sequence: Synthetic polypeptide
GGRSLVDCFLVKVGDLCDFFNWGGGGSGGVVCQDWEGVELCWQGG

SEQ ID NO: 4076 - protein, 41 aa, Artificial Sequence
  Description of Artificial Sequence: Synthetic polypeptide
GGWYPCWIARVGELCDLEGGGGSGGVVCQDWEGVELCWQGG

SEQ ID NO: 4077 - protein, 41 aa, Artificial Sequence
  Description of Artificial Sequence: Synthetic polypeptide
GGWYPCWLAQVGELCDLDGGGGSGGVVCQDWEGVELCWQGG

SEQ ID NO: 4078 - protein, 52 aa, Artificial Sequence
  Description of Artificial Sequence: Synthetic polypeptide
GGWYPCWIARVGELCDLEEGPVNRGGGGSGGGGSGGVVCQDWEGVELCWQGG

SEQ ID NO: 4079 - protein, 57 aa, Artificial Sequence
  Description of Artificial Sequence: Synthetic polypeptide
GGWYPCWIARVGELCDLEEGPVNRGGGGSGGGGSGGGGSGGVVCQDWEGVELCWQGG

SEQ ID NO: 4080 - protein, 50 aa, Artificial Sequence
  Description of Artificial Sequence: Synthetic polypeptide
GGRYVHDCFIAQVGDLCDLFLHGGGGSGGGGSGGVVCQDWEGVELCWQGG

SEQ ID NO: 4081 - protein, 55 aa, Artificial Sequence
  Description of Artificial Sequence: Synthetic polypeptide
GGRYVHDCFIAQVGDLCDLFLHGGGGSGGGGSGGGGSGGVVCQDWEGVELCWQGG

SEQ ID NO: 4082 - protein, 60 aa, Artificial Sequence
  Description of Artificial Sequence: Synthetic polypeptide
GGRYVHDCFIAQVGDLCDLFLHGGGGSGGGGSGGGGSGGGGSGGVVCQDWEGVELCWQGG

SEQ ID NO: 4083 - protein, 41 aa, Artificial Sequence
  Description of Artificial Sequence: Synthetic polypeptide
GGLVDCFKVKVGELCDLFGGGGSGGVVCQDWEGVELCWQGG

SEQ ID NO: 4084 - protein, 45 aa, Artificial Sequence; identical to SEQ ID NO: 4074
  Description of Artificial Sequence: Synthetic polypeptide

SEQ ID NO: 4085 - protein, 41 aa, Artificial Sequence
  Description of Artificial Sequence: Synthetic polypeptide
GGWYSCWMAQLGELCDLDGGGGSGGVVCQDWEGVELCWQGG

SEQ ID NO: 4086-4089 - skipped (4 entries)

SEQ ID NO: 4090 - protein, 37 aa, Artificial Sequence; identical to SEQ ID NO: 1264
  Description of Artificial Sequence: Synthetic polypeptide

SEQ ID NO: 4091 - protein, 37 aa, Artificial Sequence
  Description of Artificial Sequence: Synthetic polypeptide
WYPCWMAQLGELCDLDGGGGSGGVVCQDWEGVALCWQ

SEQ ID NO: 4092 - protein, 37 aa, Artificial Sequence
  Description of Artificial Sequence: Synthetic polypeptide
  MOD_RES (6)..(6): Abu
WYPCWXAQLGELCDLDGGGGSGGVVCQDWEGVELCWQ

SEQ ID NO: 4093 - protein, 37 aa, Artificial Sequence
  Description of Artificial Sequence: Synthetic polypeptide
  MOD_RES (6)..(6): Abu
WYPCWXAQLGELCDLDGGGGSGGVVCQDWEGVALCWQ

SEQ ID NO: 4094 - protein, 37 aa, Artificial Sequence; identical to SEQ ID NO: 1264
  Description of Artificial Sequence: Synthetic polypeptide

SEQ ID NO: 4095 - protein, 45 aa, Artificial Sequence
  Description of Artificial Sequence: Synthetic polypeptide
GGELLVDCFKVKVGELCDLFFGGGGGSGGVVCQDWEGVELCWQGG

SEQ ID NO: 4096 - protein, 45 aa, Artificial Sequence; identical to SEQ ID NO: 4074
  Description of Artificial Sequence: Synthetic polypeptide

SEQ ID NO: 4097 - protein, 45 aa, Artificial Sequence
  Description of Artificial Sequence: Synthetic polypeptide
GGKWVHDCFLAKVGDVCDLFVVGGGGSGGVVCQDWEGVELCWQGG

SEQ ID NO: 4098 - protein, 45 aa, Artificial Sequence; identical to SEQ ID NO: 4075
  Description of Artificial Sequence: Synthetic polypeptide

SEQ ID NO: 4099 - protein, 45 aa, Artificial Sequence; identical to SEQ ID NO: 4073
  Description of Artificial Sequence: Synthetic polypeptide

SEQ ID NO: 4100-8060 - skipped (3961 entries)

SEQ ID NO: 8061 - protein, 295 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEEGPVNRGGGGSGGVVCQDWEGVELCWQGG

SEQ ID NO: 8062 - protein, 294 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGAVEFYPCWLARIGELCDLVEPGGGGSGGVVCQDWEGVELCWQGG

SEQ ID NO: 8063 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDMEGGGGSGGVVCQDWEGVELCWQGG

SEQ ID NO: 8064 - protein, 293 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGEWFHDCFLAKVGDLCDLFLWGGGGSGGVVCQDWEGVELCWQGG

SEQ ID NO: 8065 - protein, 293 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGVVCQDWEGVELCWQGG

SEQ ID NO: 8066 - protein, 293 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRSLVDCFLVKVGDLCDFFNWGGGGSGGVVCQDWEGVELCWQGG

SEQ ID NO: 8067 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEGGGGSGGVVCQDWEGVELCWQGG

SEQ ID NO: 8068 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWLAQVGELCDLDGGGGSGGVVCQDWEGVELCWQGG

SEQ ID NO: 8069 - protein, 300 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEEGPVNRGGGGSGGGGSGGVVCQDWEGVELCWQGG

SEQ ID NO: 8070 - protein, 305 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEEGPVNRGGGGSGGGGSGGGGSGGVVCQDWEGVELCWQGG

SEQ ID NO: 8071 - protein, 310 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEEGPVNRGGGGSGGGGSGGGGSGGGGSGGVVCQDWEGVELCWQGG

SEQ ID NO: 8072 - protein, 298 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGGGSGGVVCQDWEGVELCWQGG

SEQ ID NO: 8073 - protein, 303 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGGGSGGGGSGGVVCQDWEGVELCWQGG

SEQ ID NO: 8074 - protein, 308 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGGGSGGGGSGGGGSGGVVCQDWEGVELCWQGG

SEQ ID NO: 8075 - protein, 288 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGAPAPAPAPAPAPAPAPAPAPAGGLVDCFKVKVGELCDLFGGGGSGGVVCQDWEGVELCWQGG

SEQ ID NO: 8076 - protein, 226 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 8077 - protein, 288 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGAPAPAPAPAPAPAPAPAPAPAGGLVDCFKVKVGELCDLFGGGGSGGVVCQDWEGVELCWQGG

SEQ ID NO: 8078 - protein, 226 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 8079 - protein, 292 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGAPAPAPAPAPAPAPAPAPAPAGGRYVHDCFIAQVGDLCDLFLHGGGGSGGVVCQDWEGVELCWQGG

SEQ ID NO: 8080 - protein, 292 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGVVCQDWEGVELCWQGG

SEQ ID NO: 8081 - protein, 287 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGGSGSGSGSGSGSGSGSGSGSGGWYSCWMAQLGELCDLDGGGGSGGVVCQDWEGVELCWQGG

SEQ ID NO: 8082 - protein, 287 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGSGSGSGSGSGSGSGSGSGGWYSCWMAQLGELCDLDGGGGSGGVVCQDWEGVELCWQGG

SEQ ID NO: 8083-9000 - skipped (918 entries)

SEQ ID NO: 9001 - protein, 20 aa, Artificial Sequence
  Description of Artificial Sequence: Synthetic peptide
YPCWLARVGELCDLDSGDVH

SEQ ID NO: 9002 - protein, 20 aa, Artificial Sequence
  Description of Artificial Sequence: Synthetic peptide
APCWLARVGELCDLDSGDVH

SEQ ID NO: 9003 - protein, 20 aa, Artificial Sequence
  Description of Artificial Sequence: Synthetic peptide
APCALARVGELCDLDSGDVH

SEQ ID NO: 9004 - protein, 20 aa, Artificial Sequence
  Description of Artificial Sequence: Synthetic peptide
APCALAAVGELCDLDSGDVH

SEQ ID NO: 9005 - protein, 20 aa, Artificial Sequence
  Description of Artificial Sequence: Synthetic peptide
APCALAAVGALCDLDSGDVH

SEQ ID NO: 9006 - protein, 20 aa, Artificial Sequence
  Description of Artificial Sequence: Synthetic peptide
APCALAAVGALCDLASGDVH

SEQ ID NO: 9007 - protein, 20 aa, Artificial Sequence
  Description of Artificial Sequence: Synthetic peptide
APCALAAVGALCDLAAGDVH

SEQ ID NO: 9008-9010 - skipped (3 entries)

SEQ ID NO: 9011 - protein, 14 aa, Artificial Sequence
  Description of Artificial Sequence: Synthetic peptide
YWCWMAQVGELCDL

SEQ ID NO: 9012 - protein, 14 aa, Artificial Sequence
  Description of Artificial Sequence: Synthetic peptide
YHCWMAQVGELCDL

SEQ ID NO: 9013 - protein, 14 aa, Artificial Sequence
  Description of Artificial Sequence: Synthetic peptide
YHCWMGQVGELCDL

SEQ ID NO: 9014 - protein, 14 aa, Artificial Sequence
  Description of Artificial Sequence: Synthetic peptide
YHCWMGQMGELCDL

SEQ ID NO: 9015 - protein, 14 aa, Artificial Sequence
  Description of Artificial Sequence: Synthetic peptide
YHCWMGQMGELCEL

SEQ ID NO: 9016 - protein, 14 aa, Artificial Sequence
  Description of Artificial Sequence: Synthetic peptide
YHCWMGQMGELCEM

SEQ ID NO: 9017-9020 - skipped (4 entries)

SEQ ID NO: 9021 - protein, 20 aa, Artificial Sequence
  Description of Artificial Sequence: Synthetic peptide
MGFYPCWTAQLGELCDLSVD

SEQ ID NO: 9022 - protein, 19 aa, Artificial Sequence
  Description of Artificial Sequence: Synthetic peptide
GFYPCWTAQLGELCDLSVD

SEQ ID NO: 9023 - protein, 18 aa, Artificial Sequence
  Description of Artificial Sequence: Synthetic peptide
FYPCWTAQLGELCDLSVD

SEQ ID NO: 9024 - protein, 17 aa, Artificial Sequence
  Description of Artificial Sequence: Synthetic peptide
YPCWTAQLGELCDLSVD

SEQ ID NO: 9025 - protein, 19 aa, Artificial Sequence
  Description of Artificial Sequence: Synthetic peptide
MGFYPCWTAQLGELCDLSV

SEQ ID NO: 9026 - protein, 18 aa, Artificial Sequence
  Description of Artificial Sequence: Synthetic peptide
MGFYPCWTAQLGELCDLS

SEQ ID NO: 9027 - protein, 17 aa, Artificial Sequence
  Description of Artificial Sequence: Synthetic peptide
MGFYPCWTAQLGELCDL

SEQ ID NO: 9028 - protein, 18 aa, Artificial Sequence
  Description of Artificial Sequence: Synthetic peptide
GFYPCWTAQLGELCDLSV

SEQ ID NO: 9029 - protein, 15 aa, Artificial Sequence
  Description of Artificial Sequence: Synthetic peptide
FYPCWTAQLGELCDL

SEQ ID NO: 9030 - skipped

SEQ ID NO: 9031 - protein, 14 aa, Artificial Sequence
  Description of Artificial Sequence: Synthetic peptide
KYCGFAQLGELCVL

SEQ ID NO: 9032 - protein, 15 aa, Artificial Sequence
  Description of Artificial Sequence: Synthetic peptide
GKYCGFAQLGELCVL

SEQ ID NO: 9033 - protein, 16 aa, Artificial Sequence
  Description of Artificial Sequence: Synthetic peptide
GGKYCGFAQLGELCVL

SEQ ID NO: 9034 - protein, 17 aa, Artificial Sequence
  Description of Artificial Sequence: Synthetic peptide
GGGKYCGFAQLGELCVL

SEQ ID NO: 9035 - protein, 15 aa, Artificial Sequence
  Description of Artificial Sequence: Synthetic peptide
KYCGFAQLGELCVLG

SEQ ID NO: 9036 - protein, 16 aa, Artificial Sequence
  Description of Artificial Sequence: Synthetic peptide
KYCGFAQLGELCVLGG

SEQ ID NO: 9037 - protein, 17 aa, Artificial Sequence
  Description of Artificial Sequence: Synthetic peptide
KYCGFAQLGELCVLGGG

SEQ ID NO: 9038 - protein, 16 aa, Artificial Sequence
  Description of Artificial Sequence: Synthetic peptide
GKYCGFAQLGELCVLG

SEQ ID NO: 9039 - protein, 17 aa, Artificial Sequence
  Description of Artificial Sequence: Synthetic peptide
GGKYCGFAQLGELCVLG

SEQ ID NO: 9040-9300 - skipped (261 entries)

SEQ ID NO: 9301 - protein, 20 aa, Artificial Sequence
  Description of Artificial Sequence: Synthetic peptide
GGWYPCWMAQLGELCDLDGG

SEQ ID NO: 9302 - protein, 19 aa, Artificial Sequence
  Description of Artificial Sequence: Synthetic peptide
GWYPCWMAQLGELCDLDGG

SEQ ID NO: 9303 - protein, 18 aa, Artificial Sequence
  Description of Artificial Sequence: Synthetic peptide
WYPCWMAQLGELCDLDGG

SEQ ID NO: 9304 - protein, 17 aa, Artificial Sequence
  Description of Artificial Sequence: Synthetic peptide
YPCWMAQLGELCDLDGG

SEQ ID NO: 9305 - protein, 16 aa, Artificial Sequence
  Description of Artificial Sequence: Synthetic peptide
PCWMAQLGELCDLDGG

SEQ ID NO: 9306 - protein, 15 aa, Artificial Sequence
  Description of Artificial Sequence: Synthetic peptide
CWMAQLGELCDLDGG

SEQ ID NO: 9307 - protein, 19 aa, Artificial Sequence
  Description of Artificial Sequence: Synthetic peptide
GGWYPCWMAQLGELCDLDG

SEQ ID NO: 9308 - protein, 18 aa, Artificial Sequence
  Description of Artificial Sequence: Synthetic peptide
GGWYPCWMAQLGELCDLD

SEQ ID NO: 9309 - protein, 17 aa, Artificial Sequence
  Description of Artificial Sequence: Synthetic peptide
GGWYPCWMAQLGELCDL

SEQ ID NO: 9310 - protein, 16 aa, Artificial Sequence
  Description of Artificial Sequence: Synthetic peptide
GGWYPCWMAQLGELCD

SEQ ID NO: 9311 - protein, 15 aa, Artificial Sequence
  Description of Artificial Sequence: Synthetic peptide
GGWYPCWMAQLGELC

SEQ ID NO: 9312 - protein, 18 aa, Artificial Sequence
  Description of Artificial Sequence: Synthetic peptide
GWYPCWMAQLGELCDLDG

SEQ ID NO: 9313 - protein, 17 aa, Artificial Sequence
  Description of Artificial Sequence: Synthetic peptide
WYPCWMAQLGELCDLDG

SEQ ID NO: 9314 - protein, 9 aa, Artificial Sequence
  Description of Artificial Sequence: Synthetic peptide
PCWMAQLGE

SEQ ID NO: 9315-9339 - skipped (25 entries)

SEQ ID NO: 9340 - protein, 18 aa, Artificial Sequence
  Description of Artificial Sequence: Synthetic peptide
GGVVCQDWEGVELCWQGG

SEQ ID NO: 9341 - protein, 17 aa, Artificial Sequence
  Description of Artificial Sequence: Synthetic peptide
GVVCQDWEGVELCWQGG

SEQ ID NO: 9342 - protein, 16 aa, Artificial Sequence
  Description of Artificial Sequence: Synthetic peptide
VVCQDWEGVELCWQGG

SEQ ID NO: 9343 - protein, 15 aa, Artificial Sequence
  Description of Artificial Sequence: Synthetic peptide
VCQDWEGVELCWQGG

SEQ ID NO: 9344 - protein, 14 aa, Artificial Sequence
  Description of Artificial Sequence: Synthetic peptide
CQDWEGVELCWQGG

SEQ ID NO: 9345 - protein, 17 aa, Artificial Sequence
  Description of Artificial Sequence: Synthetic peptide
GGVVCQDWEGVELCWQG

SEQ ID NO: 9346 - protein, 16 aa, Artificial Sequence
  Description of Artificial Sequence: Synthetic peptide
GGVVCQDWEGVELCWQ

SEQ ID NO: 9347 - protein, 15 aa, Artificial Sequence
  Description of Artificial Sequence: Synthetic peptide
GGVVCQDWEGVELCW

SEQ ID NO: 9348 - protein, 14 aa, Artificial Sequence
  Description of Artificial Sequence: Synthetic peptide
GGVVCQDWEGVELC

SEQ ID NO: 9349 - protein, 16 aa, Artificial Sequence
  Description of Artificial Sequence: Synthetic peptide
GVVCQDWEGVELCWQG

SEQ ID NO: 9350 - protein, 13 aa, Artificial Sequence
  Description of Artificial Sequence: Synthetic peptide
VCQDWEGVELCWQ

SEQ ID NO: 9351 - protein, 12 aa, Artificial Sequence
  Description of Artificial Sequence: Synthetic peptide
VCQDWEGVELCW

SEQ ID NO: 9352 - protein, 11 aa, Artificial Sequence
  Description of Artificial Sequence: Synthetic peptide
CQDWEGVELCW

SEQ ID NO: 9353 - protein, 10 aa, Artificial Sequence
  Description of Artificial Sequence: Synthetic peptide
CQDWEGVELC

SEQ ID NO: 9354-9379 - skipped (26 entries)

SEQ ID NO: 9380 - protein, 20 aa, Artificial Sequence
  Description of Artificial Sequence: Synthetic peptide
  MISC_FEATURE (1)..(20): This sequence may encompass 1-20 residues
GGGGGGGGGGGGGGGGGGGG

SEQ ID NO: 9381 - protein, 40 aa, Artificial Sequence
  Description of Artificial Sequence: Synthetic polypeptide
  MISC_FEATURE (1)..(40): This sequence may encompass 1-20 "Gly Ser" repeating units
GSGSGSGSGSGSGSGSGSGSGSGSGSGSGSGSGSGSGSGS

SEQ ID NO: 9382 - protein, 60 aa, Artificial Sequence
  Description of Artificial Sequence: Synthetic polypeptide
  MISC_FEATURE (1)..(60): This sequence may encompass 1-20 "Gly Gly Ser" repeating units
GGSGGSGGSGGSGGSGGSGGSGGSGGSGGSGGSGGSGGSGGSGGSGGSGGSGGSGGSGGS

SEQ ID NO: 9383 - protein, 80 aa, Artificial Sequence
  Description of Artificial Sequence: Synthetic polypeptide
  MISC_FEATURE (1)..(80): This sequence may encompass 1-20 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 9384 - protein, 100 aa, Artificial Sequence
  Description of Artificial Sequence: Synthetic polypeptide
  MISC_FEATURE (1)..(100): This sequence may encompass 1-20 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 9385 - protein, 10 aa, Artificial Sequence
  Description of Artificial Sequence: Synthetic peptide
  MISC_FEATURE (1)..(10): This sequence may encompass 1-10 residues
GGGGGGGGGG

SEQ ID NO: 9386 - protein, 20 aa, Artificial Sequence
  Description of Artificial Sequence: Synthetic peptide
  MISC_FEATURE (1)..(20): This sequence may encompass 1-10 "Gly Ser" repeating units
GSGSGSGSGSGSGSGSGSGS

SEQ ID NO: 9387 - protein, 30 aa, Artificial Sequence
  Description of Artificial Sequence: Synthetic polypeptide
  MISC_FEATURE (1)..(30): This sequence may encompass 1-10 "Gly Gly Ser" repeating units
GGSGGSGGSGGSGGSGGSGGSGGSGGSGGS

SEQ ID NO: 9388 - protein, 40 aa, Artificial Sequence
  Description of Artificial Sequence: Synthetic polypeptide
  MISC_FEATURE (1)..(40): This sequence may encompass 1-10 "Gly Gly Gly Ser" repeating units
GGGSGGGSGGGSGGGSGGGSGGGSGGGSGGGSGGGSGGGS

SEQ ID NO: 9389 - protein, 50 aa, Artificial Sequence
  Description of Artificial Sequence: Synthetic polypeptide
  MISC_FEATURE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 9390 - protein, 5 aa, Artificial Sequence
  Description of Artificial Sequence: Synthetic peptide
  MISC_FEATURE (1)..(5): This sequence may encompass 1-5 residues
GGGGG

SEQ ID NO: 9391 - protein, 10 aa, Artificial Sequence
  Description of Artificial Sequence: Synthetic peptide
  MISC_FEATURE (1)..(10): This sequence may encompass 1-5 "Gly Ser" repeating units
GSGSGSGSGS

SEQ ID NO: 9392 - protein, 15 aa, Artificial Sequence
  Description of Artificial Sequence: Synthetic peptide
  MISC_FEATURE (1)..(15): This sequence may encompass 1-5 "Gly Gly Ser" repeating units
GGSGGSGGSGGSGGS

SEQ ID NO: 9393 - protein, 20 aa, Artificial Sequence
  Description of Artificial Sequence: Synthetic peptide
  MISC_FEATURE (1)..(20): This sequence may encompass 1-5 "Gly Gly Gly Ser" repeating units
GGGSGGGSGGGSGGGSGGGS

SEQ ID NO: 9394 - protein, 25 aa, Artificial Sequence
  Description of Artificial Sequence: Synthetic peptide
  MISC_FEATURE (1)..(25): This sequence may encompass 1-5 "Gly Gly Gly Gly Ser" repeating units
GGGGSGGGGSGGGGSGGGGSGGGGS

SEQ ID NO: 9395 - protein, 5 aa, Artificial Sequence
  Description of Artificial Sequence: Synthetic peptide
GGGGS

SEQ ID NO: 9396 - protein, 10 aa, Artificial Sequence
  Description of Artificial Sequence: Synthetic peptide
GGGGSGGGGS

SEQ ID NO: 9397 - protein, 15 aa, Artificial Sequence
  Description of Artificial Sequence: Synthetic peptide
GGGGSGGGGSGGGGS

SEQ ID NO: 9398 - protein, 20 aa, Artificial Sequence
  Description of Artificial Sequence: Synthetic peptide
GGGGSGGGGSGGGGSGGGGS

SEQ ID NO: 9399 - protein, 2 aa, Artificial Sequence
  Description of Artificial Sequence: Synthetic peptide
GG

SEQ ID NO: 9400 - protein, 3 aa, Artificial Sequence
  Description of Artificial Sequence: Synthetic peptide
GGG

SEQ ID NO: 9401 - protein, 5 aa, Artificial Sequence
  Description of Artificial Sequence: Synthetic peptide
GGGGG

SEQ ID NO: 9402 - protein, 3 aa, Artificial Sequence
  Description of Artificial Sequence: Synthetic peptide
GGS

SEQ ID NO: 9403 - protein, 4 aa, Artificial Sequence
  Description of Artificial Sequence: Synthetic peptide
GGGS

SEQ ID NO: 9404 - protein, 7 aa, Artificial Sequence
  Description of Artificial Sequence: Synthetic peptide
GGGGSGG

SEQ ID NO: 9405 - protein, 6 aa, Artificial Sequence
  Description of Artificial Sequence: Synthetic peptide
GGSGGS

SEQ ID NO: 9406 - protein, 5 aa, Artificial Sequence
  Description of Artificial Sequence: Synthetic peptide
GGGGG

SEQ ID NO: 9407 - protein, 20 aa, Artificial Sequence
  Description of Artificial Sequence: Synthetic peptide
GSGSGSGSGSGSGSGSGSGS

SEQ ID NO: 9408-9419 - skipped (12 entries)

SEQ ID NO: 9420 - protein, 20 aa, Artificial Sequence
  Description of Artificial Sequence: Synthetic peptide
  MISC_FEATURE (1)..(20): This sequence may encompass 1-20 residues
PPPPPPPPPPPPPPPPPPPP

SEQ ID NO: 9421 - protein, 40 aa, Artificial Sequence
  Description of Artificial Sequence: Synthetic polypeptide
  MISC_FEATURE (1)..(40): This sequence may encompass 1-20 "Pro Ala" repeating units
PAPAPAPAPAPAPAPAPAPAPAPAPAPAPAPAPAPAPAPA

SEQ ID NO: 9422 - protein, 10 aa, Artificial Sequence
  Description of Artificial Sequence: Synthetic peptide
  MISC_FEATURE (1)..(10): This sequence may encompass 1-10 residues
PPPPPPPPPP

SEQ ID NO: 9423 - protein, 20 aa, Artificial Sequence
  Description of Artificial Sequence: Synthetic peptide
  MISC_FEATURE (1)..(20): This sequence may encompass 1-10 "Pro Ala" repeating units
PAPAPAPAPAPAPAPAPAPA

SEQ ID NO: 9424 - protein, 5 aa, Artificial Sequence
  Description of Artificial Sequence: Synthetic peptide
  MISC_FEATURE (1)..(5): This sequence may encompass 1-5 residues
PPPPP

SEQ ID NO: 9425 - protein, 10 aa, Artificial Sequence
  Description of Artificial Sequence: Synthetic peptide
  MISC_FEATURE (1)..(10): This sequence may encompass 1-5 "Pro Ala" repeating units
PAPAPAPAPA

SEQ ID NO: 9426 - protein, 10 aa, Artificial Sequence
  Description of Artificial Sequence: Synthetic peptide
PAPAPAPAPA

SEQ ID NO: 9427 - protein, 14 aa, Artificial Sequence
  Description of Artificial Sequence: Synthetic peptide
PAPAPAPAPAPAPA

SEQ ID NO: 9428 - protein, 20 aa, Artificial Sequence
  Description of Artificial Sequence: Synthetic peptide
PAPAPAPAPAPAPAPAPAPA

SEQ ID NO: 9429 - protein, 4 aa, Artificial Sequence
  Description of Artificial Sequence: Synthetic peptide
  MISC_FEATURE (1)..(4): This sequence may encompass 1-4 residues
GGGG

SEQ ID NO: 9430 - protein, 5 aa, Artificial Sequence
  Description of Artificial Sequence: Synthetic peptide
  MISC_FEATURE (1)..(5): This sequence may encompass 1-5 residues
GGGGG

SEQ ID NO: 9431 - protein, 6 aa, Artificial Sequence
  Description of Artificial Sequence: Synthetic 6xHis tag
HHHHHH

SEQ ID NO: 9432 - protein, 12 aa, Artificial Sequence
  Description of Artificial Sequence: Synthetic peptide
APAPAPAPAPAP

What is claimed is:

1. An IL-2Rβγc binding compound, wherein the IL-2Rβγc binding compound comprises an IL-2Rβγc ligand, wherein the IL-2Rβγc ligand comprises:
   a ligand linker;
   an IL-2Rβ ligand bound to the ligand linker, wherein the IL-2Rβ ligand comprises any one of SEQ ID NOS: 805-903, 911-913, 915-930, 2575-2655, 2661-2853, 2855-2891, 2900-2926, 2929-2939, 9301, and 9308; and
   an IL-2Rγc ligand bound to the ligand linker, wherein the IL-2Rγc ligand comprises any one of SEQ ID NOS: 944-1028, 1032, 1034, 1042, 1044, 1051-1060, and 1601-1613.

2. The IL-2Rβγc binding compound of claim 1, wherein the IL-2Rβ ligand comprises any one of SEQ ID NOS: 911-913, 915-930, 2929-2939, 9301 and 9308.

3. The IL-2Rβγc binding compound of claim 1, wherein, the IL-2Rβ ligand comprises SEQ ID NO: 865; and the IL-2Rγc ligand comprises SEQ ID NO: 965.

4. The IL-2Rβγc binding compound of claim 1, wherein the IL-2Rβγc ligand comprises a disulfide bond between two cysteines of the IL-2Rβγc ligand.

5. The IL-2Rβγc binding compound of claim 1, wherein the ligand linker comprises a peptidyl ligand linker.

6. The IL-2Rβγc binding compound of claim 1, wherein the IL-2Rβγc ligand comprises any one of SEQ ID NOS: 1263-1270, 4070-4085, and 4090-4099.

7. The IL-2Rβγc binding compound of claim 1, wherein the IL-2Rβγc ligand comprises SEQ ID NO: 1263.

8. The IL-2Rβγc binding compound of claim 1, wherein the IL-2Rβγc ligand is a full IL-2R agonist or a partial IL-2R agonist.

9. The IL-2Rβγc binding compound of claim 1, wherein,
   the IL-2Rβγc ligand exhibits an $EC_{50}$ for STAT5 phosphorylation in TF-1β cells and/or NK-92 cells of less than 100 μM; and
   the IL-2Rβγc ligand binds to hIL-2R with an IC50 less than 100 μM as determined using phage ELISA competition assays.

10. The IL-2Rβγc binding compound of claim 1, wherein the IL-2Rβγc binding compound comprises a construct partner, wherein the IL-2Rβγc ligand is bound to the construct partner.

11. The IL-2Rβγc binding compound of claim 10, wherein in the IL-2Rβγc ligand is bound to the construct partner through a construct linker.

12. The IL-2Rβγc binding compound of claim 11, wherein the construct linker comprises a peptidyl ligand linker.

13. The IL-2Rβγc binding compound of claim 10, wherein the construct partner is selected from a polymer, a polypeptide, an Fc-fragment, an immunoglobulin fragment, an antibody, a viral surface antigen or a virus-like particle, a cytokine, and a recombinant fusion protein.

14. The IL-2Rβγc binding compound of claim 10, wherein the IL-2Rβγc binding compound is selected from a polyethylene glycol, a hIgG-Fc recombinant fusion protein, and a hIgG1-Fc recombinant fusion protein.

15. The IL-2Rβγc binding compound of claim 10, wherein the construct partner comprises an antibody and the antibody is directed to a tumor antigen.

16. The IL-2Rβγc binding compound of claim 10, wherein the construct partner comprises a cell-targeting moiety.

17. The IL-2Rβγc binding compound of claim 16, wherein cell-targeting moiety comprises a tumor-targeting moiety, an immune cell-targeting moiety, or a combination thereof.

18. The IL-2Rβγc binding compound of claim 1, wherein the IL-2Rβ ligand comprises any one of SEQ ID NO: 2818, 2819, 2856, 2859, 2862, and 2934.

19. The IL-2Rβγc binding compound of claim 1, wherein,
   the IL-2Rβ ligand comprises any one of SEQ ID NO: 2818, 2819, 2856, 2859, 2862, and 2934; and
   the IL-2Rγc ligand comprises SEQ ID NO: 965.

20. The IL-2Rβγc binding compound of claim 1, wherein the ligand linker comprises $(G)_n$ (SEQ ID NO: 9380), $(GS)_n$ (SEQ ID NO: 9381), $(GGS)_n$ (SEQ ID NO: 9382), $(GGGS)_n$ (SEQ ID NO: 9383), $(GGGGS)_n$ (SEQ ID NO: 9384), or a combination of any of the foregoing, wherein n is an integar from 1 to 20.

21. The IL-2Rβγc binding compound of claim 1, wherein the ligand linker comprises (GGGGS) (SEQ ID NO: 9395), (GGGGS)2 (SEQ ID NO: 9396), (GGGGS)3 (SEQ ID NO: 9397), (GGGGS)4 (SEQ ID NO: 9398), (GG) (SEQ ID NO: 9399), (GGG) (SEQ ID NO: 9400), (GGGGG) (SEQ ID NO: 9401), (GGS) (SEQ ID NO: 9402), (GGGS) (SEQ ID NO: 9403), (GGGGSGG) (SEQ ID NO: 9404), (GGS)2 (SEQ ID NO: 9405), (G)5 (SEQ ID NO: 9406), or (GS)10 (SEQ ID NO: 9407).

22. A pharmaceutical composition comprising the IL-2Rβγc binding compound of claim 1.

* * * * *